US011060075B2

(12) United States Patent
Miller et al.

(10) Patent No.: US 11,060,075 B2
(45) Date of Patent: Jul. 13, 2021

(54) ENGINEERED DNA POLYMERASE VARIANTS

(71) Applicant: Codexis, Inc., Redwood City, CA (US)

(72) Inventors: Mathew G. Miller, San Carlos, CA (US); Vesna Mitchell, Santa Clara, CA (US); Jovana Nazor, Milpitas, CA (US); Donald S. Baskerville, Louisville, CO (US); Nikki Dellas, Mountain View, CA (US); David Elgart, San Mateo, CA (US); Jonathan Vroom, South San Francisco, CA (US); Sandy M. Gomes, Redwood City, CA (US); Nandhitha Subramanian, San Francisco, CA (US); Ericka Bermudez, Aptos, CA (US)

(73) Assignee: Codexis, Inc., Redwood City, CA (US)

( * ) Notice: Subject to any disclaimer, the term of this patent is extended or adjusted under 35 U.S.C. 154(b) by 0 days.

(21) Appl. No.: 16/666,280

(22) Filed: Oct. 28, 2019

(65) Prior Publication Data

US 2020/0131485 A1    Apr. 30, 2020

Related U.S. Application Data

(60) Provisional application No. 62/752,215, filed on Oct. 29, 2018.

(51) Int. Cl.
*C12P 19/34* (2006.01)
*C12N 9/12* (2006.01)

(52) U.S. Cl.
CPC .................................. *C12N 9/1252* (2013.01)

(58) Field of Classification Search
CPC ..................... C12Y 207/07007; C12N 9/1252
See application file for complete search history.

(56) References Cited

U.S. PATENT DOCUMENTS

| | | | |
|---|---|---|---|
| 4,683,195 A | 7/1987 | Mullis et al. |
| 5,605,793 A | 2/1997 | Stemmer |
| 5,811,238 A | 9/1998 | Stemmer et al. |
| 5,830,721 A | 11/1998 | Stemmer et al. |
| 5,834,252 A | 11/1998 | Stemmer et al. |
| 5,837,458 A | 11/1998 | Minshull et al. |
| 5,928,905 A | 7/1999 | Stemmer et al. |
| 6,096,548 A | 8/2000 | Stemmer |
| 6,117,679 A | 9/2000 | Stemmer |
| 6,132,970 A | 10/2000 | Stemmer |
| 6,165,793 A | 12/2000 | Stemmer |
| 6,180,406 B1 | 1/2001 | Stemmer |
| 6,251,674 B1 | 6/2001 | Tobin et al. |
| 6,265,201 B1 | 7/2001 | Wackett et al. |
| 6,277,638 B1 | 8/2001 | Stemmer |
| 6,287,861 B1 | 9/2001 | Stemmer et al. |
| 6,287,862 B1 | 9/2001 | delCardayre et al. |
| 6,291,242 B1 | 9/2001 | Stemmer |
| 6,297,053 B1 | 10/2001 | Stemmer |
| 6,303,344 B1 | 10/2001 | Patten et al. |
| 6,309,883 B1 | 10/2001 | Minshull et al. |
| 6,319,713 B1 | 11/2001 | Patten et al. |
| 6,319,714 B1 | 11/2001 | Crameri et al. |
| 6,323,030 B1 | 11/2001 | Stemmer |
| 6,326,204 B1 | 12/2001 | delCardayre et al. |
| 6,335,160 B1 | 1/2002 | Patten et al. |
| 6,335,198 B1 | 1/2002 | delCardayre et al. |
| 6,337,186 B1 | 1/2002 | Krebber |
| 6,344,356 B1 | 2/2002 | Stemmer |
| 6,352,859 B1 | 3/2002 | delCardayre et al. |
| 6,355,484 B1 | 3/2002 | Patten et al. |
| 6,358,740 B1 | 3/2002 | Patten et al. |
| 6,358,742 B1 | 3/2002 | Stemmer |
| 6,365,377 B1 | 4/2002 | Patten et al. |
| 6,365,408 B1 | 4/2002 | Stemmer |
| 6,368,861 B1 | 4/2002 | Crameri et al. |
| 6,372,497 B1 | 4/2002 | Stemmer |
| 6,376,246 B1 | 4/2002 | Crameri et al. |
| 6,379,964 B1 | 4/2002 | delCardayre et al. |
| 6,387,702 B1 | 5/2002 | Stemmer |
| 6,391,552 B2 | 5/2002 | Stemmer |
| 6,391,640 B1 | 5/2002 | Minshull et al. |
| 6,395,547 B1 | 5/2002 | Stemmer |
| 6,406,855 B1 | 6/2002 | Patten et al. |
| 6,406,910 B1 | 6/2002 | Patten et al. |
| 6,413,745 B1 | 7/2002 | Patten et al. |
| 6,413,774 B1 | 7/2002 | Stemmer |
| 6,420,175 B1 | 7/2002 | Stemmer |
| 6,423,542 B1 | 7/2002 | Crameri et al. |

(Continued)

FOREIGN PATENT DOCUMENTS

| | | |
|---|---|---|
| EP | 3 049 973 B1 | 8/2018 |
| WO | 95/22625 A1 | 8/1995 |

(Continued)

OTHER PUBLICATIONS

Altschul, S., et al., "Basic local alignment search tool," J. Mol. Biol., 215: 403-410 (1990).
Altschul, S.F., et al., "Gapped BLAST and PSI-BLAST: a new generation of protein database search programs," Nucleic Acids Res., 25(17):3389-3402 (1997).
Barnes, W.M., "The fidelity of Taq polymerase catalyzing PCR is improved by an N-terminal deletion," Gene, 112:29-35 [1992].
Beaucage, S.L., et al., "Deoxynucleoside phosphoamidites—A new class of key intermediates for deoxypolynucleotide synthesis," Tetrahedron Letters, 22(20):1859-62 (1981).
Black, M.E., et al., "Creation of drug-specific herpes simplex virus type 1 thymidine kinase mutants for gene therapy," Proc Natl Acad Sci USA, 93:3525-3529 (1996).

(Continued)

*Primary Examiner* — Tekchand Saidha
(74) *Attorney, Agent, or Firm* — Codexis, Inc.

(57) ABSTRACT

The present invention provides engineered DNA polymerase polypeptides and compositions thereof, as well as polynucleotides encoding the engineered DNA polymerase polypeptides. The invention also provides methods for use of the compositions comprising the engineered DNA polymerase polypeptides for diagnostic and other purposes.

27 Claims, 3 Drawing Sheets

Specification includes a Sequence Listing.

(56) References Cited

U.S. PATENT DOCUMENTS

| | | |
|---|---|---|
| 6,426,224 B1 | 7/2002 | Crameri et al. |
| 6,436,675 B1 | 8/2002 | Welch et al. |
| 6,444,468 B1 | 9/2002 | Stemmer et al. |
| 6,455,253 B1 | 9/2002 | Patten et al. |
| 6,479,652 B1 | 11/2002 | Crameri et al. |
| 6,482,647 B1 | 11/2002 | Stemmer |
| 6,483,011 B1 | 11/2002 | Stemmer et al. |
| 6,484,105 B2 | 11/2002 | Zhang |
| 6,489,146 B2 | 12/2002 | Stemmer et al. |
| 6,500,617 B1 | 12/2002 | Stemmer et al. |
| 6,500,639 B2 | 12/2002 | Subramanian |
| 6,506,602 B1 | 1/2003 | Stemmer |
| 6,506,603 B1 | 1/2003 | Stemmer |
| 6,518,065 B1 | 2/2003 | Stemmer |
| 6,519,065 B1 | 2/2003 | Colbourne et al. |
| 6,521,453 B1 | 2/2003 | Crameri et al. |
| 6,528,311 B1 | 3/2003 | delCardayre et al. |
| 6,531,316 B1 | 3/2003 | Patten et al. |
| 6,537,746 B2 | 3/2003 | Arnold et al. |
| 6,573,098 B1 | 6/2003 | Stemmer |
| 6,576,467 B1 | 6/2003 | Stemmer |
| 6,579,678 B1 | 6/2003 | Patten et al. |
| 6,586,182 B1 | 7/2003 | Patten et al. |
| 6,605,430 B1 | 7/2003 | Affholter et al. |
| 6,602,986 B1 | 8/2003 | Stemmer et al. |
| 6,613,514 B2 | 9/2003 | Patten et al. |
| 6,653,072 B1 | 11/2003 | Patten et al. |
| 6,686,515 B1 | 2/2004 | Lassner et al. |
| 6,703,240 B1 | 3/2004 | Stemmer et al. |
| 6,716,631 B1 | 4/2004 | delCardayre et al. |
| 6,825,001 B2 | 11/2004 | Wackett et al. |
| 6,902,922 B2 | 6/2005 | Ness et al. |
| 6,917,882 B2 | 7/2005 | Selfinov et al. |
| 6,946,296 B2 | 9/2005 | Patten et al. |
| 6,961,664 B2 | 11/2005 | Selfinov et al. |
| 6,995,017 B1 | 2/2006 | Stemmer |
| 7,024,312 B1 | 4/2006 | Selfinov et al. |
| 7,058,515 B1 | 6/2006 | Selfinov et al. |
| 7,105,297 B2 | 9/2006 | Minshull et al. |
| 7,148,054 B2 | 12/2006 | delCardayre et al. |
| 7,220,566 B2 | 5/2007 | Ness et al. |
| 7,288,375 B2 | 10/2007 | Stemmer et al. |
| 7,384,387 B1 | 6/2008 | Raillard et al. |
| 7,421,347 B2 | 9/2008 | Selfinov et al. |
| 7,430,477 B2 | 9/2008 | Selfinov et al. |
| 7,462,469 B2 | 12/2008 | Bass et al. |
| 7,534,564 B2 | 5/2009 | Patten et al. |
| 7,620,500 B2 | 11/2009 | Mundorff et al. |
| 7,620,502 B2 | 11/2009 | Selfinov et al. |
| 7,629,157 B2 | 12/2009 | Davis et al. |
| 7,629,170 B2 | 12/2009 | delCardayre et al. |
| 7,702,464 B1 | 4/2010 | Emig et al. |
| 7,747,391 B2 | 6/2010 | Gustafsson et al. |
| 7,747,393 B2 | 6/2010 | Fox |
| 7,751,986 B2 | 7/2010 | Gustafsson et al. |
| 7,776,598 B2 | 8/2010 | Patten et al. |
| 7,783,428 B2 | 8/2010 | Gustafsson et al. |
| 7,795,030 B2 | 9/2010 | Minshull et al. |
| 7,853,410 B2 | 12/2010 | Selfinov et al. |
| 7,868,138 B2 | 1/2011 | Stemmer et al. |
| 7,873,477 B1 | 1/2011 | Gustafsson et al. |
| 7,873,499 B2 | 1/2011 | Selfinov et al. |
| 7,904,249 B2 | 3/2011 | Selfinov et al. |
| 7,957,912 B2 | 6/2011 | Selfinov et al. |
| 7,981,614 B2 | 7/2011 | Stemmer et al. |
| 8,014,961 B2 | 9/2011 | Bass et al. |
| 8,029,988 B2 | 10/2011 | Crameri et al. |
| 8,048,674 B2 | 11/2011 | Minshull et al. |
| 8,058,001 B2 | 11/2011 | Crameri et al. |
| 8,076,138 B2 | 12/2011 | delCardayre et al. |
| 8,108,150 B2 | 1/2012 | Mundorff et al. |
| 8,170,806 B2 | 5/2012 | Selfinov et al. |
| 8,224,580 B2 | 7/2012 | Mundorff et al. |
| 8,377,681 B2 | 2/2013 | delCardayre et al. |
| 8,383,346 B2 | 2/2013 | Colbeck et al. |
| 8,457,903 B1 | 6/2013 | Emig et al. |
| 8,504,498 B2 | 8/2013 | Fox |
| 8,589,085 B2 | 11/2013 | Selfinov et al. |
| 8,762,066 B2 | 6/2014 | Fox |
| 8,768,871 B2 | 7/2014 | Fox |
| 9,593,326 B2 | 3/2017 | Clark et al. |
| 9,665,694 B2 | 5/2017 | Cope |
| 9,684,771 B2 | 6/2017 | Cope et al. |
| 2008/0015116 A1 | 1/2008 | Bass et al. |
| 2008/0220990 A1 | 9/2008 | Fox |
| 2009/0312196 A1 | 12/2009 | Colbeck et al. |
| 2011/0082055 A1 | 4/2011 | Fox et al. |
| 2016/0244787 A1 | 8/2016 | Chan et al. |
| 2017/0051326 A1 | 2/2017 | Bourn et al. |
| 2017/0204384 A1 | 7/2017 | Skirgaila et al. |

FOREIGN PATENT DOCUMENTS

| | | |
|---|---|---|
| WO | 95/33836 A1 | 12/1995 |
| WO | 96/00787 A1 | 1/1996 |
| WO | 97/0078 A1 | 1/1997 |
| WO | 97/35966 A1 | 10/1997 |
| WO | 98/27230 A1 | 6/1998 |
| WO | 00/42651 A1 | 7/2000 |
| WO | 01/75767 A2 | 10/2001 |
| WO | 2009/152336 A1 | 12/2009 |
| WO | 2010/144103 A1 | 12/2010 |
| WO | 2015/048573 A1 | 4/2015 |

OTHER PUBLICATIONS

Botstein, D., et al., "Strategies and applications of in vitro mutagenesis," Science, 229(4719):1193-1201, 1985.

Caldwell, R.C., et al., "Mutagenic PCR," PCR Methods Appl., 3:S136-S140 [1994].

Carter, P., "Site-directed mutagenesis," Biochem. J., 237:1-7 (1986).

Christians, F.C., et al., "Directed evolution of thymidine kinase for AZT phosphorylation using DNA family shuffling," Nat. Biotechnol., 17:259-264 (1999).

Crameri, A., et al., "DNA shuffling of a family of genes from diverse species accelerates directed evolution", Nature, 391:288-291 (1998).

Crameri, A., et al., "Improved green fluorescent protein by molecular evolution using DNA shufffing," Nat. Biotechnol., 14(3):315-319 (1996).

Crameri, A., et al., "Molecular evolution of an arsenate detoxification pathway by DNA shuffling," Nat. Biotechnol., 15(5):436-438 (1997).

Dale, S.J., et al. "Oligonucleotide-directed random mutagenesis using the phosphorothioate method," Methods Mol. Biol., 57:369-74 (1996).

De Boer, H.A., et al., "The tac promoter: A functional hybrid derived from the trp and lac promoters," Proc. Natl Acad. Sci. USA, 80: 21-25 (1983).

Guo, Z., et al., "3'-End-Forming Signals of Yeast mRNA," Mol. Cell. Biol., 15(11):5983-5990 [1995].

Hanahan, D., "Studies on Transformation fo *Escherichia coli* with Plasmids," J. Mol. Biol., 166: 557-580 [1983].

Henikoff, S., et al., "Amino acid substitution matrices from protein blocks," Proc. Natl. Acad. Sci. USA, 89:10915-10919 [1992].

Jozwiakowski, S.K., et al., "Plasmid-based lacZ-alpha assay for DNA polymerase fidelity: application to archaeal family-B DNA polymerase," Nucl. Acids Res., 37(15): e102 [2009].

Kitabayashi, M., et al., "Gene Cloning and Polymerase Chain Reaction with Proliferating Cell Nuclear Antigen from Thermococcus kodakaraensis KOD1," Biosci. Biotechnol. Biochem., 66(10): 2194-2200 [2002].

Kramer, B., et al., "Different base/base mismatches are corrected with different efficiencies by the methyl-directed DNA mismatch-repair system of *E. coil*," Cell, 38(3):879-887, 1984.

Ling, M.M., et al., "Approaches to DNA Mutagenesis: An Overview," Anal. Biochem., 254(2):157-78 [1997].

(56) References Cited

OTHER PUBLICATIONS

Matthes, H.W.D., et al., "Simultaneous rapid chemical synthesis of over one hundred oligonucleotides on a microscale," EMBO J., 3(4):801-05 (1984).
Minshull, J., et al., "Protein evolution by molecular breeding," Curr. Op. Chem. Biol., 3(3):284-290 (1999).
Needleman, S., et al., "A general method applicable to the search for similarities in the amino acid sequence of two proteins," J. Mol. Biol. 48:443-453 (1970).
Pearson, W.R., "Improved tools for biological sequence comparison," Proc. Nat'l. Acad. Sci. USA, 85:2444-2448 (1988).
Romanos, M.A., et al., "Foreign gene expression in yeast: a review," Yeast 8:423-488 [1992].
Simonen, M., et al., "Protein Secretion in *Bacillus* Species," Microbiological Reviews, 57:109-137 (1993).
Smith, M., "In vitro mutagenesis," Ann. Rev. Genet., 19:423-462 (1985).
Smith, T., et al., "Comparison of Biosequences," Adv. Appl. Math, 2:482-489 (1981).
Stemmer, W., "DNA Shuffling by Random Fragmentation and Reassembly: In vitro Recombination for Molecular Evolution," Proc. Natl. Acad. Sci. USA, 91:10747-10751 (1994).
Stemmer, W.P.C., "Rapid evolution of a protein in vitro by DNA shuffling", Nature, 370:389-391 (1994).
Tindall, K.R., et al., "Fidelity of DNA Synthesis by the Thermus aquaticus DNA Polymerase," Biochem., 27(16):6008-6013 [1988].
Villa-Komaroff, L., et al., "A bacterial clone synthesizing proinsulin," Proc. Natl Acad. Sci. USA, 75:3727-3731 (1978).
Wells, J.A., et al., "Cassette mutagenesis: an efficient method for generation of multiple mutations at defined sites," Gene, 34:315-323 (1985).
Zhang, J-H., et al., "Directed evolution of a fucosidase from a galactosidase by DNA shuffling and screening ," Proc. Nat. Acad. Sci., U.S.A., 94:4504-4509 (1997).
Zhao, H., et al., "Molecular evolution by staggered extension process (StEP) in vitro recombination," Nat. Biotechnol., 16:258-261 (1998).
UniProtKB/TrEMBL IAccession No. A0A0U3SCT0 dated Mar. 16, 2016.

US 11,060,075 B2

ENGINEERED DNA POLYMERASE VARIANTS

The present application claims priority U.S. Prov. Pat. Appln. Ser. No. 62/752,215, filed Oct. 29, 2018, which is incorporated by reference in its entirety for all purposes.

REFERENCE TO SEQUENCE LISTING, TABLE OR COMPUTER PROGRAM

The Sequence Listing concurrently submitted herewith under 37 C.F.R. § 1.821 in a computer readable form (CRF) via EFS-Web as file name CX9-181US2_ST25_Substitute.txt is herein incorporated by reference. The electronic copy of the Sequence Listing was created on Nov. 19, 2019, with a file size of 5,165 Kbytes.

FIELD OF THE INVENTION

The present invention provides engineered DNA polymerase polypeptides and compositions thereof, as well as polynucleotides encoding the engineered DNA polymerase polypeptides. The invention also provides methods for use of the compositions comprising the engineered DNA polymerase polypeptides for diagnostic and other purposes.

BACKGROUND OF THE INVENTION

DNA polymerases are enzymes that synthesize DNA from deoxyribonucleotides. These enzymes are essential for DNA replication. There are various types of DNA polymerases, which have generally been divided into seven families, namely A, B, C, D, X, Y, and RT. These families have different properties and are found in different types of organisms. For example, Group A polymerases are replicative and repair polymerases that are found in both eukaryotic and prokaryotic organisms (examples include T7 DNA polymerase, and E. coli polI). Group B polymerases are also replicative and repair enzymes that are found in eukaryotic and prokaryotic organisms (e.g., pol II, pol B, etc.) Groups C and D contains replicative polymerases that are found in prokaryotic organisms and the Euryarchaeota, respectively (the Group C polymerases include pol III, but the Group D polymerases are not well characterized). The Group X, Y, and RT polymerases are replicative and repair enzymes that are found in eukaryotes (Group X), eukaryotes and prokaryotes (Group Y), and viruses, retroviruses, and eukaryotes (Group RT). Examples of Group X polymerases include pol β, while Group Y polymerases include pol IV and pol V, and Group RT polymerases include the polymerase of hepatitis B virus. Some of these polymerases, particularly those obtained from thermophilic organisms, have found tremendous use in various in vitro methods, including but not limited to the polymerase chain reaction (PCR). The availability of thermophilic polymerases made the automation of PCR possible. Thus, these are very important enzymes in applications in which PCR is useful. While there are numerous enzymes commercially available (e.g., Taq and many others), a need remains in the art for thermostable enzymes with high levels of fidelity.

SUMMARY OF THE INVENTION

The present invention provides engineered DNA polymerase polypeptides and compositions thereof, as well as polynucleotides encoding the engineered DNA polymerase polypeptides. The invention also provides methods for use of the compositions comprising the engineered DNA polymerase polypeptides for diagnostic and other purposes.

The present invention provides engineered DNA polymerases comprising polypeptide sequences having at least 85%, 90%, 91%, 92%, 93%, 94%, 95%, 96%, 97%, 98%, 99%, or more sequence identity to the reference sequence of SEQ ID NO: 2, 6, 22, 24, 26, 28, and/or 824, or a functional fragment thereof, wherein the engineered DNA polymerase comprises at least one substitution or substitution set in its polypeptide sequence, and wherein the amino acid positions of the polypeptide sequence are numbered with reference to SEQ ID NO: 2, 6, 22, 24, 26, 28, and/or 824.

The present invention also provides engineered DNA polymerases comprising at least one substitution or substitution set at position(s) selected from 21, 21/66/247/282, 247/282/575, 282/575, 283/647/702/743, 339/647/661/664/668/702/712, 372/391/702, 391, 391/647/659/661/668/671/712/716, 391/647/659/661/668/671/716, 391/647/659/664/668/702/728/732, 391/647/659/664/671/702, 391/647/661/664/671/702/716, 391/647/671/728, 391/659/702/716/732/737, 391/661/664/668/671/716/737, 391/671, 391/702/712/716/732/743, 647/659/661/664/668/702, 647/659/664/668/702/712/737, 647/659/668/671/716/728, 647/668, 647/668/671/712, 659/702/743, 661/664/668/671/716, 668/702, 671/702, 671/702/716, 702, and 743, and/or any combinations thereof, wherein the amino acid positions are numbered with reference to SEQ ID NO: 6. In some embodiments, the at least one substitution or substitution set is selected from 21E, 21E/66T/247G/282R, 247G/282K/575L, 282K/575L, 283M/647H/702A/743A, 339L/647H/661T/664L/668E/702A/712V, 372S/391E/702A, 391E, 391E/647H/659E/661T/668E/671P/712V/716I, 391E/647H/659E/661T/668E/671P/716I, 391E/647H/659E/664L/668E/702A/728A/732E, 391E/647H/659E/664L/671P/702A, 391E/647H/661T/664L/671P/702A/716I, 391E/647H/671P/728A, 391E/659E/702A/716I/732E/737R, 391E/661T/664L/668E/671P/716I/737R, 391E/671P, 391E/702A/712V/716I/732E/743A, 647H/659E/661T/664L/668E/702A, 647H/659E/664L/668E/702A/712V/737R, 647H/659E/668E/671P/716I/728A, 647H/668E, 647H/668E/671P/712V, 659E/702A/743A, 661T/664L/668E/671P/716I, 668E/702A, 671P/702A, 671P/702A/716I, 702A, and 743A, wherein the amino acid positions are numbered with reference to SEQ ID NO: 6.

The present invention also provides engineered DNA polymerases comprising at least one substitution or substitution set at position(s) selected from 18/387, 24/719, 43/528, 48/760, 101/646, 108/679, 223, 257, 282, 359, 360, 361, 362, 376/619, 390, 391, 394, 394/399, 420, 421, 478, 502, 506, 514, 515, 521, 528, 583/730, 603, 619, 631, 646, 655, 662, 666, 668, 685, 691, 702, 721, 738, 754, 760, and 761, and/or any combinations thereof, wherein the amino acid positions are numbered with reference to SEQ ID NO: 6. In some embodiments, the at least one substitution or substitution set is selected from 18H/387C, 24M/719A, 43L/528S, 48H/760H, 101S/646R, 108C/679S, 223N, 257R, 257W, 282R, 359C, 360R, 360T, 360V, 361G, 361M, 361W, 362R, 376V/619F, 390A, 390G, 390Q, 391A, 391G, 394G, 394M/399R, 394N, 394T, 420A, 420G, 420I, 420K, 420V, 421M, 421Q, 478L, 502A, 506R, 514R, 515F, 515G, 515R, 521P, 521T, 528A, 528S, 583N/730A, 603R, 619C, 619V, 631G, 646R, 655W, 662C, 666T, 668C, 668L, 685D, 691S, 702A, 721R, 721T, 738V, 754C, 760F, 760G, 761R, and 761W, and/or any combinations thereof, wherein the amino acid positions are numbered with reference to SEQ ID NO: 6. In some embodiments, the at least one substitution or substitution set is selected from Y18H/E387C, K24M/

K719A, P43L/T528S, Y48H/E760H, P101S/K646R, R108C/Q679S, D223N, M257R, M257W, N282R, R359C, S360R, S360T, S360V, S361G, S361M, S361W, T362R, A376V/T619F, Y390A, Y390G, Y390Q, K391A, K391G, L394G, L394M/L399R, L394N, L394T, R420A, R420G, R420I, R420K, R420V, S421M, S421Q, K478L, L502A, S506R, P514R, K515F, K515G, K515R, K521P, K521T, T528A, T528S, S583N/L730A, V603R, T619C, T619V, E631G, K646R, E655W, E662C, K666T, R668C, R668L, K685D, G691S, T702A, S721R, S721T, K738V, A754C, E760F, E760G, A761R, and A761W, and/or any combinations thereof, wherein the amino acid positions are numbered with reference to SEQ ID NO: 6.

The present invention also provides engineered DNA polymerases comprising at least one substitution or substitution set at position(s) selected from 174/361/394/666/668/721, 360/391, 361/391/659, 361/394/420/528/646/666/721/743, 361/394/420/528/666, 361/394/420/646/666/702/721/743, 361/528/646/666, 361/528/646/702/721, 361/528/666, 361/646, 394/420, 502/507/695, 528/646/659/668/743, 528/666, 528/668, 528/743, 619, 666, and 685/691/743, and/or any combinations thereof, wherein the amino acid positions are numbered with reference to SEQ ID NO: 22. In some embodiments, the at least one substitution or substitution set is selected from 174V/361G/394T/666T/668L/721T, 360T/391G, 361G/394T/420A/528A/666T, 361G/394T/420A/528S/646R/666T/721T/743P, 361G/528A/646R/666T, 361G/528A/666T, 361G/528S/646R/702T/721T, 361G/646R, 361M/391A/659D, 361W/394T/420A/646R/666T/702T/721T/743P, 394G/420K, 502I/507F/695A, 528S/646R/659D/668L/743P, 528S/666T, 528S/668L, 528S/743P, 619C, 666T, and 685D/691S/743P, and/or any combinations thereof, wherein the amino acid positions are numbered with reference to SEQ ID NO:22. In some embodiments, the at least one substitution or substitution set is selected from A174V/S361G/L394T/K666T/R668L/S721T, S360T/K391G, S361G/L394T/R420A/T528A/K666T, S361G/L394T/R420A/T528S/K646R/K666T/S721T/A743P, S361G/T528A/K646R/K666T, S361G/T528A/K666T, S361G/T528S/K646R/A702T/S721T, S361G/K646R, S361M/K391A/E659D, S361W/L394T/R420A/K646R/K666T/A702T/S721T/A743P, L394G/R420K, L502I/Y507F/S695A, T528S/K646R/E659D/R668L/A743P, T528S/K666T, T528S/R668L, T528S/A743P, T619C, K666T, and K685D/G691S/A743P and/or any combinations thereof, wherein the amino acid positions are numbered with reference to SEQ ID NO: 22.

The present invention also provides engineered DNA polymerases comprising at least one substitution or substitution set at position(s) selected from 100, 277, 280, 281, 283, 339, 401, 468, 479, 480, 482, 489, 490, 491, 496, 497, and 498, and/or any combinations thereof, wherein the amino acid positions are numbered with reference to SEQ ID NO: 22. In some embodiments, the at least one substitution or substitution set is selected from 100Y, 277A, 280Y, 281C, 283V, 339M, 401S, 468N, 479P, 479Q, 480D, 480M, 482Q, 482V, 489V, 490L, 491L, 496A, 497D, and 498C, and/or any combinations thereof, wherein the amino acid positions are numbered with reference to SEQ ID NO:22. In some embodiments, the at least one substitution or substitution set is selected from H100Y, V277A, T280Y, I281C, L283V, F339M, G401S, G468N, K479P, K479Q, K480D, K480M, K482Q, K482V, E489V, K490L, K491L, R496A, Q497D, and R498C and/or any combinations thereof, wherein the amino acid positions are numbered with reference to SEQ ID NO:22.

The present invention also provides engineered DNA polymerases comprising at least one substitution or substitution set at position(s) selected from 15/134/482/490/497/671/685, 234/497/647, 257/390/420, 257/390/420/647, 257/401/420, 257/401/420/482/647/671/685, 257/482/497/647, 257/647, 257/671/685/702, 281, 281/391/478, 281/391/478/685, 281/391/488/492, 281/391/495/561/659/668, 281/391/659/668, 281/391/668, 281/478/659/685/702, 281/478/668, 281/488, 281/488/492/495/659/668, 281/488/492/668/702, 281/488/495, 281/488/495/668, 281/492/495/668, 281/492/495/668/702, 281/668, 390/401/716, 390/420, 390/491/671, 390/497, 390/671/685, 391, 391/478, 391/478/479/668, 391/478/492/668, 391/479/659/668, 391/488/492/659/685, 391/488/492/668, 391/488/495/668/685/702, 391/492/495, 391/492/495/659, 391/492/515/659/685, 391/495/659, 401, 401/482/659/671/702, 401/490, 401/490/659/671, 401/671, 420, 420/482/659/702, 420/490, 420/490/659/661/671, 420/659/702, 420/661/671, 420/685, 478, 478/479, 478/479/668, 478/479/702, 478/488/659, 478/488/668/685/702, 478/515, 479/492, 479/659/678, 482/497/647/716, 482/497/671/685, 482/671/702/716, 488, 488/492, 488/492/495, 488/495, 488/495/685, 490/497/661/671/685/702/716, 492, 492/495/659/668, 492/659/685, 492/668/685/712, 492/668/712, 495, 495/659, 495/659/685, 497/647, 497/647/659/671, 497/659/691/716, 497/661, 497/661/671, 497/671/702, 497/671/716, 497/685, 497/702, 515, 659, 659/691, and 671, and/or any combinations thereof, wherein the amino acid positions are numbered with reference to SEQ ID NO: 24. In some embodiments, the at least one substitution or substitution set is selected from 15N/134N/482Q/490L/497D/671P/685K, 234V/497D/647H, 257W/390H/420Q, 257W/390Q/420Q/647H, 257W/401S/420Q, 257W/401S/420Q/482Q/647H/671P/685K, 257W/482Q/497D/647H, 257W/647H, 257W/671P/685K/702T, 281C, 281C/391E/478L/685K, 281C/391E/488R/492V, 281C/391G/478L, 281C/391G/495N/561A/659D/668E, 281C/391G/659D/668E, 281C/391G/668E, 281C/478L/659D/685K/702T, 281C/478L/668E, 281C/488R, 281C/488R/492V/495N/659D/668E, 281C/488R/492V/668E/702T, 281C/488R/495N, 281C/488R/495N/668E, 281C/492V/495N/668E, 281C/492V/495N/668E/702T, 281C/668E, 390Q/401S/716I, 390Q/420Q, 390Q/491D/671P, 390Q/497D, 390Q/671P/685K, 391E, 391E/478L, 391E/478L/479P/668E, 391E/488R/492V/659D/685K, 391E/488R/492V/668E, 391E/492V/495N/659D, 391G/478L/492V/668E, 391G/479P/659D/668E, 391G/488R/495N/668E/685K/702T, 391G/492V/495N, 391G/492V/515L/659D/685K, 391G/495N/659D, 401S, 401S/482Q/659D/671P/702T, 401S/490L, 401S/490L/659D/671P, 401S/671P, 420G, 420Q, 420Q/482Q/659D/702T, 420Q/490L, 420Q/490L/659D/661T/671P, 420Q/659D/702T, 420Q/661T/671P, 420Q/685K, 478L, 478L/479P, 478L/479P/668E, 478L/479P/702T, 478L/488R/659D, 478L/488R/668E/685K/702T, 478L/515L, 479P/492V, 479P/659D/678G, 482Q/497D/647H/716I, 482Q/497D/671P/685K, 482Q/671P/702T/716I, 488R, 488R/492V, 488R/492V/495N, 488R/495N, 488R/495N/685K, 490L/497D/661T/671P/685K/702T/716I, 492V, 492V/495N/659D/668E, 492V/659D/685K, 492V/668E/685K/712V, 492V/668E/712V, 495N, 495N/659D, 495N/659D/685K, 497D/647H, 497D/647H/659D/671P, 497D/659D/691G/716I, 497D/661T, 497D/661T/671P, 497D/671P/702T, 497D/671P/716I, 497D/685K, 497D/702T, 515L, 659D, 659D/691G, and 671P, and/or any combinations thereof, wherein the amino acid positions are numbered with reference to SEQ ID NO: 24. In some embodiments, the at least one substitution or substitution set is selected from D15N/D134N/K482Q/K490L/Q497D/L671P/D685K, A234V/Q497D/D647H, M257W/Y390H/R420Q, M257W/ Y390Q/R420Q/D647H, M257W/G401S/R420Q, M257W/ G401S/R420Q/K482Q/D647H/L671P/D685K, M257W/ K482Q/Q497D/D647H, M257W/D647H, M257W/L671P/ D685K/A702T, I281C, I281C/K391E/K478L/D685K, I281C/K391E/I488R/M492V, I281C/K391G/K478L, I281C/K391G/Y495N/T561A/E659D/R668E, I281C/ K391G/E659D/R668E, I281C/K391G/R668E, I281C/ K478L/E659D/D685K/A702T, I281C/K478L/R668E, I281C/I488R, I281C/I488R/M492V/Y495N/E659D/ R668E, I281C/I488R/M492V/R668E/A702T, I281C/I488R/ Y495N, I281C/I488R/Y495N/R668E, I281C/M492V/ Y495N/R668E, I281C/M492V/Y495N/R668E/A702T, I281C/R668E, Y390Q/G401S/L716I, Y390Q/R420Q, Y390Q/K491D/L671P, Y390Q/Q497D, Y390Q/L671P/ D685K, K391E, K391E/K478L, K391E/K478L/K479P/ R668E, K391E/I488R/M492V/E659D/D685K, K391E/ I488R/M492V/R668E, K391E/M492V/Y495N/E659D, K391G/K478L/M492V/R668E, K391G/K479P/E659D/ R668E, K391G/I488R/Y495N/R668E/D685K/A702T, K391G/M492V/Y495N, K391G/M492V/K515L/E659D/ D685K, K391G/Y495N/E659D, G401S, G401S/K482Q/ E659D/L671P/A702T, G401S/K490L, G401S/K490L/ E659D/L671P, G401S/L671P, R420G, R420Q, R420Q/ K482Q/E659D/A702T, R420Q/K490L, R420Q/K490L/ E659D/V661T/L671P, R420Q/E659D/A702T, R420Q/ V661T/L671P, R420Q/D685K, K478L, K478L/K479P, K478L/K479P/R668E, K478L/K479P/A702T, K478L/ I488R/E659D, K478L/I488R/R668E/D685K/A702T, K478L/K515L, K479P/M492V, K479P/E659D/E678G, K482Q/Q497D/D647H/L716I, K482Q/Q497D/L671P/ D685K, K482Q/L671P/A702T/L716I, I488R, I488R/ M492V, I488R/M492V/Y495N, I488R/Y495N, I488R/ Y495N/D685K, K490L/Q497D/V661 T/L671P/D685K/ A702T/L716I, M492V, M492V/Y495N/E659D/R668E, M492V/E659D/D685K, M492V/R668E/D685K/I712V, M492V/R668E/I712V, Y495N, Y495N/E659D, Y495N/ E659D/D685K, Q497D/D647H, Q497D/D647H/E659D/ L671P, Q497D/E659D/S691G/L716I, Q497D/V661T, Q497D/V661T/L671P, Q497D/L671P/A702T, Q497D/ L671P/L716I, Q497D/D685K, Q497D/A702T, K515L, E659D, E659D/S691G, and L671P, wherein the amino acid positions are numbered with reference to SEQ ID NO: 24.

The present invention also provides engineered DNA polymerases comprising at least one substitution or substitution set at position(s) selected from 55/579, 108, 108/521, 156/451, 236/755, 240, 247, 248, 256, 298, 299, 299/319, 302, 309, 316, 319, 350, 356, 357, 358, 370, 384, 385, 386, 389, 406, 407, 411, 415, 440, 443, 447, 450, 451, 520, 536, 539, 540, 544, 550/575, 566, 568, 575, 579, 579/767, 600, 601, 601/638, 609/648, 624, 634, 648, 656, 672, 758, 765, 767, 772, 777, 778, 779, 780, 782, 784, and 785, and/or any combinations thereof, wherein the amino acid positions are numbered with reference to SEQ ID NO: 24. In some embodiments, the at least one substitution or substitution set is selected from 55E/579V, 55G/579A, 108A, 108C, 108F, 108G, 108S, 108V/521R, 108Y, 156L/451C, 236R/755T, 240A, 240Y, 247I, 247S, 248P, 256A, 298E, 299A, 299A/ 319G, 299E, 299Q, 299R, 302F, 309V, 316G, 319E, 319H, 319S, 350V, 356N, 356P, 356V, 357S, 358I, 370D, 370S, 370T, 384R, 385L, 386G, 386P, 386V, 389Q, 389R, 406V, 407A, 407L, 407R, 407S, 407Y, 411H, 415V, 440H, 443V, 447A, 447L, 450L, 450Y, 451G, 520C, 536N, 536Q, 536T, 539G, 539H, 539Q, 539S, 539V, 540G, 544G, 550S/575Q, 566G, 566Q, 568G, 568L, 575F, 575T, 579A, 579M, 579Q, 579Q/767Q, 579R, 579S, 600A, 601I, 601L/638L, 601M, 601V, 609C/648Q, 624C, 624S, 634R, 648Q, 648R, 656A, 656Y, 672G, 758V, 765D, 767G, 767T, 772G, 777D, 778Q, 779D, 780A, 780W, 782S, 782V, 784-, and 785G, and/or any combinations thereof, wherein the amino acid positions are numbered with reference to SEQ ID NO: 24. In some embodiments, the at least one substitution or substitution set is selected from D55E/N579V, D55G/N579A, R108A, R108C, R108F, R108G, R108S, R108V/K521R, R108Y, F156L/V451C, K236R/V755T, R240A, R240Y, K247I, K247S, E248P, R256A, K298E, T299A, T299A/K319G, T299E, T299Q, T299R, K302F, A309V, E316G, K319E, K319H, K319S, I350V, D356N, D356P, D356V, V357S, S358I, L370D, L370S, L370T, K384R, P385L, D386G, D386P, D386V, E389Q, E389R, P406V, E407A, E407L, E407R, E407S, E407Y, W411H, I415V, E440H, E443V, I447A, I447L, I450L, I450Y, V451G, S520C, E536N, E536Q, E536T, I539G, I539H, I539Q, I539S, I539V, K540G, E544G, V550S/R575Q, K566G, K566Q, E568G, E568L, R575F, R575T, N579A, N579M, N579Q, N579Q/ E767Q, N579R, N579S, G600A, F601I, F601L/A638L, F601M, F601V, A609C/G648Q, V624C, V624S, K634R, G648Q, G648R, I656A, I656Y, E672G, I758V, R765D, E767G, E767T, Q772G, T777D, G778Q, L779D, D780A, D780W, W782S, W782V, K784-, and R785G, and/or any combinations thereof, wherein the amino acid positions are numbered with reference to SEQ ID NO: 24.

The present invention also provides engineered DNA polymerases comprising at least one substitution or substitution set at position(s) selected from 248, 281, 281/302, 281/492, 302/401, 339/491/492/579/712, 390/466/539/712, and 661, and/or any combinations thereof, wherein the amino acid positions are numbered with reference to SEQ ID NO: 26. In some embodiments, the at least one substitution or substitution set is selected from 248P, 281I, 281I/ 302F, 281I/492S, 302F/401S, 339A/491D/492V/579A/ 712V, 390Q/466A/539S/712V, and 661T, and/or any combinations thereof, wherein the amino acid positions are numbered with reference to SEQ ID NO: 26. In some embodiments, the at least one substitution or substitution set is selected from E248P, C281I, C281I/K302F, C281I/ M492S, K302F/G401S, F339A/K491D/M492V/N579A/ I712V, Y390Q/I466A/I539S/I712V, and V661T, and/or any combinations thereof, wherein the amino acid positions are numbered with reference to SEQ ID NO: 26.

The present invention also provides engineered DNA polymerases comprising at least one substitution or substitution set at position(s) selected from 240/579, 240/579/702, 248/391/539/579/659/702, 248/391/659, 302/391/579, 339/ 390/420/425/466/490/491/515/702, 391, 391/482, 391/659, 420/515, 579, 579/659/702, 579/702, and 659/702, and/or any combinations thereof, wherein the amino acid positions are numbered with reference to SEQ ID NO: 28. In some embodiments, the at least one substitution or substitution set is selected from 240A/579A, 240A/579A/702A, 248P/ 391G/539S/579A/659D/702A, 248P/391G/659D, 302F/ 391G/579A, 339A/390Q/420G/425R/466A/490L/491P/ 515L/702A, 391G, 391G/482Q, 391/659D, 420G/515F, 579A, 579A/659D/702A, 579A/702A, and 659D/702A, and/or any combinations thereof, wherein the amino acid positions are numbered with reference to SEQ ID NO: 28. In some embodiments, the at least one substitution or substitution set is selected from R240A/N579A, R240A/ N579A/T702A, E248P/K391G/I539S/N579A/E659D/ T702A, E248P/K391G/E659D, K302F/K391G/N579A, F339A/Y390Q/R420G/S425R/I466A/K490L/K491P/ K515L/T702A, K391G, K391G/K482Q, K391G/E659D, R420G/K515F, N579A, N579A/E659D/T702A, N579A/ T702A, and E659D/T702A, and/or any combinations thereof, wherein the amino acid positions are numbered with reference to SEQ ID NO: 28.

The present invention also provides engineered DNA polymerases comprising at least one substitution or substitution set at position(s) selected from 257, 420, 515, and 521, and/or any combinations thereof, wherein the amino acid positions are numbered with reference to SEQ ID NO: 6. In some embodiments, the at least one substitution or substitution set is selected from 257W, 420Q, 515L, and 521S, and/or any combinations thereof, wherein the amino acid positions are numbered with reference to SEQ ID NO: 6. In some embodiments, the at least one substitution or substitution set is selected from M257W, R420Q, K515L, and K521S, and/or any combinations thereof, wherein the amino acid positions are numbered with reference to SEQ ID NO: 6.

The present invention also provides engineered DNA polymerases comprising at least one substitution or substitution set at position(s) selected from 71/361/702/721/738, 277, 281, 339, 391/491, 401, 479, 480, 482, 488, 490, 491, 492, 495, 497, 528/646/659/668/743, 702/743, and 743, and/or any combinations thereof, wherein the amino acid positions are numbered with reference to SEQ ID NO: 22. In some embodiments, the at least one substitution or substitution set is selected from 71D/361M/702T/721R/738V, 277A, 281C, 339M, 391N/491Q, 401S, 479P, 480M, 482Q, 482V, 488R, 490L, 490Y, 491D, 492V, 495N, 497D, 528S/646R/659D/668L/743P, 702T/743P, and 743P, and/or any combinations thereof, wherein the amino acid positions are numbered with reference to SEQ ID NO: 22. In some embodiments, the at least one substitution or substitution set is selected from G71D/S361M/A702T/S721R/K738V, V277A, I281C, F339M, K391N/K491Q, G401S, K479P, K480M, K482Q, K482V, I488R, K490L, K490Y, K491D, M492V, Y495N, Q497D, T528S/K646R/E659D/R668L/A743P, A702T/A743P, and A743P, and/or any combinations thereof, wherein the amino acid positions are numbered with reference to SEQ ID NO: 22.

The present invention also provides engineered DNA polymerases comprising at least one substitution or substitution set at position(s) selected from 240, 370, 385, 539, 540, 550/575, 634, and 777, and/or any combinations thereof, wherein the amino acid positions are numbered with reference to SEQ ID NO: 24. In some embodiments, the at least one substitution or substitution set is selected from 240A, 370T, 385L, 539V, 540G, 540Q, 550S/575Q, 634R, and 777D, and 743P, and/or any combinations thereof, wherein the amino acid positions are numbered with reference to SEQ ID NO: 24. In some embodiments, the at least one substitution or substitution set is selected from R240A, L370T, P385L, I539V, K540G, K540Q, V550S/R575Q, K634R, and T777D, and/or any combinations thereof, wherein the amino acid positions are numbered with reference to SEQ ID NO: 24.

The present invention also provides engineered DNA polymerases comprising at least one substitution or substitution set at position(s) selected from 390/391, 482, and 515, and/or any combinations thereof, wherein the amino acid positions are numbered with reference to SEQ ID NO: 28. In some embodiments, the at least one substitution or substitution set is selected from 390Q/391G, 482Q, 515F, and 515L, and/or any combinations thereof, wherein the amino acid positions are numbered with reference to SEQ ID NO: 28. In some embodiments, the at least one substitution or substitution set is selected from Y390Q/K391G, K482Q, K515F, and K515L, and/or any combinations thereof, wherein the amino acid positions are numbered with reference to SEQ ID NO: 28.

The present invention also provides engineered DNA polymerases comprising at least one substitution or substitution set at position(s) selected from 281, 281/579, and/or any combinations thereof, wherein the amino acid positions are numbered with reference to SEQ ID NO: 28. In some embodiments, the at least one substitution or substitution set is selected from 281I and 281I/579A, and/or any combinations thereof, wherein the amino acid positions are numbered with reference to SEQ ID NO: 28. In some embodiments, the at least one substitution or substitution set is selected from C281I and C281I/N579A, and/or any combinations thereof, wherein the amino acid positions are numbered with reference to SEQ ID NO: 28.

The present invention also provides engineered DNA polymerases comprising at least one substitution or substitution set at position(s) selected from 13, 15, 19, 26, 52, 55, 61, 80, 81, 82, 95, 111, 118, 141, 148, 152, 156, 162, 163, 179, 181, 187, 189, 191, 196, 208, 221, 229, 231, 242, 258, 274, 297, 313, 314, 317, 325, 326, 333, 349, 377, 387, 394, 395, 411, 447, 450, 451, 453, 469, 482, 496, 502, 520, 521, 537, 563, 564, 564/572, 567, 569, 575, 580, 601, 603, 619, 620, 648, 667, 673, 690, 705, 719, 731, 758, 761, 772, 774, 775, 778, 783, and 784, and/or any combinations thereof, wherein the amino acid positions are numbered with reference to SEQ ID NO: 824. In some embodiments, the at least one substitution or substitution set is selected from 13T, 15G, 15W, 19S, 26S, 52M, 55K, 55P, 61R, 80G, 81T, 82Q, 95R, 111A, 111V, 118V, 141R, 141S, 148P, 152T, 156R, 162Q, 163A, 163G, 163K, 163P, 163Q, 163W, 179G, 181R, 187L, 189G, 191A, 191N, 196A, 196R, 208C, 221G, 229S, 231H, 242L, 258L, 258R, 258S, 274I, 274L, 274V, 297F, 313F, 314V, 317P, 317R, 317T, 325Q, 326K, 333R, 349I, 377W, 387A, 387S, 394G, 394R, 395H, 411T, 447V, 450V, 451Y, 453R, 469H, 469L, 482V, 496S, 502W, 520C, 521V, 537G, 537K, 563L, 564D/572G, 564Q, 567G, 569G, 569L, 569T, 575H, 575W, 580A, 580I, 601I, 603R, 619L, 619V, 620K, 648F, 667N, 667T, 673M, 690L, 705L, 719A, 731G, 758V, 761P, 772S, 774R, 775F, 775G, 778P, 778R, 783Q, 783R, and 784E, wherein the amino acid positions are numbered with reference to SEQ ID NO: 824. In some additional embodiments, the at least one substitution or substitution set is selected from 113T, D15G, D15W, 119S, 126S, L52M, D55K, D55P, E61A, E61R, V80G, K81T, V82Q, K95R, I111A, I111V, I118V, E141R, E141S, L148P, D152T, F156R, E162Q, F163A, F163G, F163K, F163P, F163Q, F163W, A179G, V181R, I187L, L189G, Y191A, Y191N, S196A, S196R, V208C, N221G, Y229S, I231H, V242L, G258L, G258R, G258S, F274I, F274L, F274V, G297F, E313F, T314V, S317P, S317R, S317T, S325Q, M326K, Y333R, L349I, R377W, E387A, E387S, L394G, L394R, R395H, W411T, I447V, I450V, V451Y, Y453R, D469H, D469L, K482V, R496S, L502W, S520C, K521V, M537G, M537K, P563L, G564D/K572G, G564Q, P567G, I569G, I569L, I569T, R575H, R575W, Y580A, Y580I, F601I, V603R, T619L, T619V, R620K, G648F, Y667N, Y667T, K673M, I690L, I705L, K719A, L731G, I758V, A761P, Q772S, S774R, K775F, K775G, G778P, G778R, L783Q, L783R, and K784E, wherein the amino acid positions are numbered with reference to SEQ ID NO: 824.

The present invention also provides engineered DNA polymerases comprising at least one substitution or substitution set at position(s) selected from 15/447/569/775/783/784, 82/242/569, 82/450/567/569, 313, 314/447/569/783/784, 537/667, 567/569/667, and 569, and/or any combinations thereof, wherein the amino acid positions are numbered with reference to SEQ ID NO: 824. In some embodiments, the at least one substitution or substitution set is selected from 15W/447V/569T/775F/783Q/784E, 82Q/242L/569L, 82Q/450V/567G/569G, 313F, 314V/447V/569T/783Q/784E, 537K/667N, 567G/569G/667N, and 569T, wherein the amino acid positions are numbered with reference to SEQ ID NO: 824. In some additional embodiments, the at least one substitution or substitution set is selected from D15W/I447V/I569T/K775F/L783Q/K784E, V82Q/V242L/I569L, V82Q/I450V/P567G/I569G, E313F, T314V/I447V/I569T/L783Q/K784E, M537K/Y667N, P567G/I569G/Y667N, and I569T, wherein the amino acid positions are numbered with reference to SEQ ID NO: 824.

The present invention also provides engineered DNA polymerases, wherein the engineered DNA polymerases comprise polypeptide sequences that are at least 85%, 90%, 91%, 92%, 93%, 94%, 95%, 96%, 97%, 98%, 99% or more identical to the sequence of at least one engineered DNA polymerase variant set forth in Table 3.1, 3.2, 3.3, 3.4, 3.5, 3.6, 3.7, 3.8, 3.9, 4.1, 4.2, 4.3, 4.4, 4.5, 6.2, and/or 6.3. In some embodiments, the engineered DNA polymerase has DNA polymerase activity. In some embodiments, the engineered DNA polymerase has at least one improved property, as compared to a wild-type DNA polymerase. In some embodiments, the wild-type DNA polymerase is selected from Pfu DNA polymerase from *Pyrococcus furiosus*, Group B DNA polymerase from *Thermococcus* sp. strain 2319x1, and Taq DNA polymerase from *Thermus aquaticus*. In some embodiments, the engineered DNA polymerase has at least one improved property, as compared to wild-type DNA polymerase, wherein the improved property is selected from producing increased product in polymerase chain reactions, greater fidelity, and greater thermostability. In some embodiments, the engineered DNA polymerase produces a greater product yield in polymerase chain reactions than wild-type DNA polymerase. In some embodiments, the wild-type DNA polymerase is selected from Pfu DNA polymerase from *Pyrococcus furiosus*, Group B DNA polymerase from *Thermococcus* sp. strain 2319x1, and Taq DNA polymerase from *Thermus aquaticus*. In some additional embodiments, the engineered DNA polymerase exhibits greater fidelity than wild-type DNA polymerase. In some embodiments, the wild-type DNA polymerase selected from Pfu DNA polymerase from *Pyrococcus furiosus*, Group B DNA polymerase from *Thermococcus* sp. strain 2319x1, and Taq DNA polymerase from *Thermus aquaticus*. In yet some additional embodiments, the engineered DNA polymerase exhibits greater thermostability than wild-type DNA polymerase. In some further embodiments, the wild-type DNA polymerase selected from Pfu DNA polymerase from *Pyrococcus furiosus*, Group B DNA polymerase from *Thermococcus* sp. strain 2319x1, and Taq DNA polymerase from *Thermus aquaticus*. In yet some further embodiments, the engineered DNA polymerase is purified.

The present invention also provides polynucleotide sequences encoding the engineered DNA polymerases provided herein. In some embodiments, the polynucleotide sequence encodes at least one engineered DNA polymerase provided herein. In some additional embodiments, the polynucleotide sequence comprises at least 85%, 90%, 91%, 92%, 93%, 94%, 95%, 96%, 97%, 98%, 99%, or more sequence identity to the reference sequence of SEQ ID NO: 1, 5, 21, 23, 25, 27, and/or 823, or a functional fragment thereof, wherein the engineered polypeptide comprises at least one substitution at one or more amino acid positions. In some additional embodiments, the polynucleotide sequence encodes at least one engineered DNA polymerase comprises a sequence having at least 85%, 90%, 91%, 92%, 93%, 94%, 95%, 96%, 97%, 98%, 99%, or more sequence identity to the reference sequence of SEQ ID NO: 2, 6, 22, 24, 26, 28, and/or 824. In some further embodiments, the polynucleotide sequence comprises SEQ ID NO: 1, 5, 21, 23, 25, 27, and/or 823. In some additional embodiments, the polynucleotide sequence is operably linked to a control sequence. In yet some further embodiments, the polynucleotide sequence is codon-optimized.

The present invention also provides expression vectors comprising at least one polynucleotide sequence provided herein. The present invention also provides host cells transformed with at least one expression vector provided herein.

The present invention also provides methods of producing an engineered DNA polymerase polypeptide in a host cell comprising culturing a host cell provided herein, under suitable culture conditions, such that at least one engineered DNA polymerase is produced. In some embodiments, the methods further comprise recovering at least one engineered DNA polymerase from the culture and/or host cells. In some additional embodiments, the methods further comprise the step of purifying the at least one engineered DNA polymerase. The present invention also provides compositions comprising at least one engineered DNA polymerase provided herein.

The present invention also provides high-throughput assay systems for determination of DNA polymerase fidelity. The present invention also provides methods for high-throughput fidelity determination of a DNA polymerase, comprising: i) providing: at least one DNA polymerase; a reporter plasmid comprising genes encoding a first reporter protein and a second reporter protein and a selection marker; an amplification system, including a thermocycler and reagents for conducting a polymerase chain reaction; and a purification system; an transformation system, including competent host cells; and a flow cytometer; ii) exposing the DNA polymerase and the reporter plasmid to the amplification system, under conditions such that the reporter construct is amplified by the DNA polymerase to produce PCR product; iii) circularizing the PCR amplicons to provide circularized PCR amplicons; vi) transforming the PCR amplicons using the transformation system to produce transformed cells; and vii) analyzing the transformed cells using the flow cytometer; and viii) determining the fidelity of the DNA polymerase. In some embodiments, the methods comprise at least one DNA polymerase provided herein (e.g., as provided in any of the Examples and Tables). In some embodiments, the methods further comprise the step of inducing the transformed cells. In some additional embodiments, the first reporter protein comprises green fluorescent protein. In yet some further embodiments, the second reporter protein comprises dsRed. In still additional embodiments, the selection marker comprises chloramphenicol acetyltransferase. In some further embodiments, the circularization of the PCR amplicons is conducted using at least one ligase. In some embodiments, the PCR amplicons are purified. In some additional embodiments, the methods further comprise determining the fold-improvement in polymerase fidelity as compared to a reference DNA polymerase. In some embodiments, the reference DNA polymerase is a wild-type polymerase. In some further embodiments, the wild-type polymerase is selected from Pfu DNA polymerase from *Pyrococcus furiosus*, Group B DNA polymerase from *Thermococcus* sp. strain 2319x1, and Taq DNA polymerase from *Thermus aquaticus*. In some embodiments, the relative error rate for each variant is calculated by dividing the first fluorescent protein (e.g., green-only) frequency for the variant by the frequency for a parental control. In some additional embodiments, the fold-improvement in polymerase fidelity is reported and the relative error rate determined.

DESCRIPTION OF THE INVENTION

Figure 1:
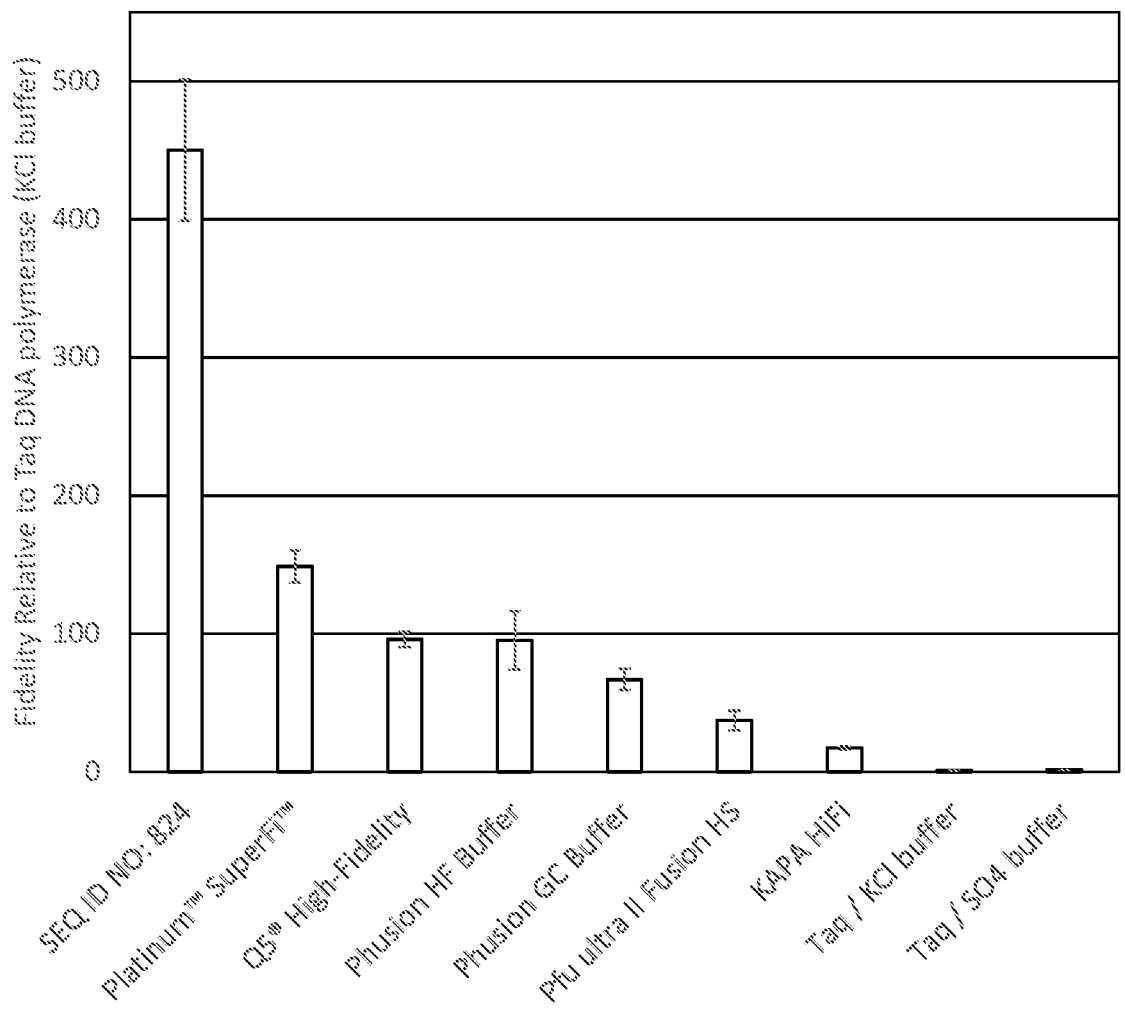
FIG. 1 provides a graph showing the relative error rates of the polymerases tested as described in Example 5.

The present invention provides engineered DNA polymerase polypeptides and compositions thereof, as well as polynucleotides encoding the engineered DNA polymerase polypeptides. The invention also provides methods for use of the compositions comprising the engineered DNA polymerase polypeptides for diagnostic and other purposes. In some embodiments, the engineered DNA polymerase polypeptides are optimized to provide enhanced polymerization activity with high replication fidelity, particularly under conditions involving low concentrations of DNA input, high-throughput analysis and/or sequencing reactions. In some embodiments, the present invention provides methods and compositions comprising the engineered DNA polymerases for diagnostic and research purposes. The present invention also provides engineered DNA polymerase polypeptides, mutants, biologically active fragments and analogues thereof, and compositions comprising the same.

In some embodiments, the engineered DNA polymerases of the present invention find use in diagnostic and research applications using small amounts of DNA from patient samples, including cell-free DNA, circulating tumor DNA, DNA isolated from circulating tumor cells, circulating fetal DNA, DNA isolated from virally infected cells, fine-needle aspirates, or single cells isolated by FACS (fluorescence activated cell sorting), laser-capture microscopy, or microfluidic devices. However, it is not intended that the sample used with the present invention be limited to any particular sample type, as any suitable sample, including those with low DNA concentrations finds use in the present invention.

In some embodiments, the engineered DNA polymerases of the present invention find use in the construction of DNA sequencing libraries for intermediate to high-concentration DNA samples.

In some embodiments, the engineered DNA polymerases of the present invention find use in molecular cloning applications, particularly those where the DNA concentration is low compared to the Km of naturally occurring enzymes. In some embodiments, this applies to high-throughput cloning applications where sample is prepared in small volumes, or any low-concentration DNA sample such as environmental samples, patient samples, or ancient DNA.

In some embodiments, the engineered DNA polymerases of the present invention find use in simplified molecular biology workflows, included automated workflows, which remove cleanup steps between operations. Because engineered DNA polymerases are active on low-concentration substrates, a smaller volume (or a dilution) of the substrate sample containing inhibitor can be added to the ligation reaction. Relevant inhibitor-containing DNA samples may include DNA in PCR buffer, DNA in electrophoresis buffer, or DNA in crude extracts. Engineered DNA polymerases of the present invention are capable of efficiently ligate diluted samples, as compared to native DNA polymerases. Alternatively, in other embodiments, engineered DNA polymerases of the present invention find use on undiluted samples containing inhibitor(s).

In some embodiments, the engineered DNA polymerases of the present invention find use in single-pot multi-enzyme reactions, performed in microfluidic droplets, or wellplates. The high specific activity of the DNA polymerases allow for buffer formulations selected for the performance of other enzymes in the reaction, which achieving ligation performance that is not limiting for the overall workflow.

In some embodiments, the engineered DNA polymerases of the present invention find use in the construction of DNA libraries. These libraries may be used for DNA sequencing, high-throughput screening, genetic selections, phage display, yeast display, ribosomal display, cell-based assays, biochemical assays, or imaging-based high-content screening. In some embodiments, the engineered DNA polymerases of the present invention find particular utility when the library size, diversity, or fidelity is limited by ligation substrate concentration when a wild-type DNA polymerase is used.

Abbreviations and Definitions

Unless defined otherwise, all technical and scientific terms used herein generally have the same meaning as commonly understood by one of ordinary skill in the art to which this invention pertains. Generally, the nomenclature used herein and the laboratory procedures of cell culture, molecular genetics, microbiology, organic chemistry, analytical chemistry and nucleic acid chemistry described below are those well-known and commonly employed in the art. Such techniques are well-known and described in numerous texts and reference works well known to those of skill in the art. Standard techniques, or modifications thereof, are used for chemical syntheses and chemical analyses.

All patents, patent applications, articles and publications mentioned herein, both supra and infra, are hereby expressly incorporated herein by reference.

Although any suitable methods and materials similar or equivalent to those described herein find use in the practice of the present invention, some methods and materials are described herein. It is to be understood that this invention is not limited to the particular methodology, protocols, and reagents described, as these may vary, depending upon the context they are used by those of skill in the art. Accordingly, the terms defined immediately below are more fully described by reference to the application as a whole. All patents, patent applications, articles and publications mentioned herein, both supra and infra, are hereby expressly incorporated herein by reference.

As used herein, the singular "a", "an," and "the" include the plural references, unless the context clearly indicates otherwise.

Numeric ranges are inclusive of the numbers defining the range. Thus, every numerical range disclosed herein is intended to encompass every narrower numerical range that falls within such broader numerical range, as if such narrower numerical ranges were all expressly written herein. It is also intended that every maximum (or minimum) numerical limitation disclosed herein includes every lower (or higher) numerical limitation, as if such lower (or higher) numerical limitations were expressly written herein.

The term "about" means an acceptable error for a particular value. In some instances "about" means within 0.05%, 0.5%, 1.0%, or 2.0%, of a given value range. In some instances, "about" means within 1, 2, 3, or 4 standard deviations of a given value.

Furthermore, the headings provided herein are not limitations of the various aspects or embodiments of the invention which can be had by reference to the application as a whole. Accordingly, the terms defined immediately below are more fully defined by reference to the application as a whole. Nonetheless, in order to facilitate understanding of the invention, a number of terms are defined below.

Unless otherwise indicated, nucleic acids are written left to right in 5' to 3' orientation; amino acid sequences are written left to right in amino to carboxy orientation, respectively.

As used herein, the term "comprising" and its cognates are used in their inclusive sense (i.e., equivalent to the term "including" and its corresponding cognates).

As used herein, the "EC" number refers to the Enzyme Nomenclature of the Nomenclature Committee of the International Union of Biochemistry and Molecular Biology (NC-IUBMB). The IUBMB biochemical classification is a numerical classification system for enzymes based on the chemical reactions they catalyze.

As used herein, "ATCC" refers to the American Type Culture Collection whose biorepository collection includes genes and strains.

As used herein, "NCBI" refers to National Center for Biological Information and the sequence databases provided therein.

As used herein, the term "DNA" refers to deoxyribonucleic acid.

As used herein, the term "RNA" refers to ribonucleic acid.

As used herein, the terms "fusion protein," and "chimeric protein" and "chimera" refer to hybrid proteins created through the joining of two or more genes that originally encoded separate proteins. In some embodiments, fusion proteins are created by recombinant technology (e.g., molecular biology techniques known in the art).

As used herein, the term "polymerase" refers to a class of enzymes that polymerize nucleoside triphosphates. Polymerases use a template nucleic acid strand to synthesize a complementary nucleic acid strand. The template strand and synthesized nucleic acid strand can independently be either DNA or RNA. Polymerases known in the art include but are not limited to DNA polymerases (e.g., E. coli DNA polI, T. aquaticus DNA polymerase [Taq], DNA-dependent RNA polymerases, and reverse transcriptases). As used herein, the polymerase is a polypeptide or protein containing sufficient amino acids to carry out a desired enzymatic function of the polymerase. In some embodiments, the polymerase does not contain all of the amino acids found in the native enzyme, but only those which are sufficient to allow the polymerase to carry out a desired catalytic activity, including but not limited to 5'-3' polymerization, 5'-3' exonuclease, and 3'-5' exonuclease activities.

As used herein, the term "DNA polymerase activity," "synthetic activity," and "polymerase activity" are used interchangeably herein, and refer to the ability of an enzyme to synthesize new DNA strands by the incorporation of deoxynucleoside triphosphates.

As used herein, the terms "duplex" and "ds" refer to a double-stranded nucleic acid (e.g., DNA) molecule comprised of two single-stranded polynucleotides that are complementary in their sequence (A pairs to T, C pairs to G), arranged in an antiparallel 5' to 3' orientation, and held together by hydrogen bonds between the nucleobases (i.e., adenine [A], guanine [G], cytosine [C], and thymine [T]).

As used herein, the term "blunt" refers to the end of a DNA duplex or single-stranded ("ss") DNA with self-complementarity that does not have a 5' or 3' overhang. Blunt ends may have 5' phosphates on one or both strands, which make them compatible for ligation via a ligase such as T4 DNA ligase.

As used herein, the term "end repair" refers to methods for repairing DNA (e.g., fragmented or damaged DNA or DNA molecules that are incompatible with other DNA molecules). In some embodiments, the process involves two functions: 1) conversion of double-stranded DNA with overhangs to double-stranded DNA without overhangs by an enzyme such as T4 DNA polymerase and/or Klenow fragment; and 2) addition of a phosphate group to the 5' ends of DNA (single- or double-stranded), by an enzyme such as polynucleotide kinase.

"Protein," "polypeptide," and "peptide" are used interchangeably herein to denote a polymer of at least two amino acids covalently linked by an amide bond, regardless of length or post-translational modification (e.g., glycosylation or phosphorylation).

"Amino acids" are referred to herein by either their commonly known three-letter symbols or by the one-letter symbols recommended by IUPAC-IUB Biochemical Nomenclature Commission. Nucleotides, likewise, may be referred to by their commonly accepted single letter codes. The abbreviations used for the genetically encoded amino acids are conventional and are as follows: alanine (Ala or A), arginine (Arg or R), asparagine (Asn or N), aspartate (Asp or D), cysteine (Cys or C), glutamate (Glu or E), glutamine (Gln or Q), histidine (His or H), isoleucine (Ile or I), leucine (Leu or L), lysine (Lys or K), methionine (Met or M), phenylalanine (Phe or F), proline (Pro or P), serine (Ser or S), threonine (Thr or T), tryptophan (Trp or W), tyrosine (Tyr or Y), and valine (Val or V). When the three-letter abbreviations are used, unless specifically preceded by an "L" or a "D" or clear from the context in which the abbreviation is used, the amino acid may be in either the L- or D-configuration about α-carbon ($C_α$). For example, whereas "Ala" designates alanine without specifying the configuration about the α-carbon, "D-Ala" and "L-Ala" designate D-alanine and L-alanine, respectively. When the one-letter abbreviations are used, upper case letters designate amino acids in the L-configuration about the α-carbon and lower case letters designate amino acids in the D-configuration about the α-carbon. For example, "A" designates L-alanine and "a" designates D-alanine. When polypeptide sequences are presented as a string of one-letter or three-letter abbreviations (or mixtures thereof), the sequences are presented in the amino (N) to carboxy (C) direction in accordance with common convention.

The abbreviations used for the genetically encoding nucleosides are conventional and are as follows: adenosine (A); guanosine (G); cytidine (C); thymidine (T); and uridine (U). Unless specifically delineated, the abbreviated nucleosides may be either ribonucleosides or 2'-deoxyribonucleosides. The nucleosides may be specified as being either ribonucleosides or 2'-deoxyribonucleosides on an individual basis or on an aggregate basis. When nucleic acid sequences are presented as a string of one-letter abbreviations, the sequences are presented in the 5' to 3' direction in accordance with common convention, and the phosphates are not indicated.

The terms "engineered," "recombinant," "non-naturally occurring," and "variant," when used with reference to a cell, a polynucleotide or a polypeptide refers to a material or a material corresponding to the natural or native form of the material that has been modified in a manner that would not otherwise exist in nature or is identical thereto but produced or derived from synthetic materials and/or by manipulation using recombinant techniques.

As used herein, "wild-type" and "naturally-occurring" refer to the form found in nature. For example a wild-type polypeptide or polynucleotide sequence is a sequence present in an organism that can be isolated from a source in nature and which has not been intentionally modified by human manipulation.

As used herein, "coding sequence" refers to that part of a nucleic acid (e.g., a gene) that encodes an amino acid sequence of a protein.

As used herein, the term "percent (%) sequence identity" refers to comparisons among polynucleotides and polypeptides, and are determined by comparing two optimally aligned sequences over a comparison window, wherein the portion of the polynucleotide or polypeptide sequence in the comparison window may comprise additions or deletions (i.e., gaps) as compared to the reference sequence for optimal alignment of the two sequences. The percentage may be calculated by determining the number of positions at which the identical nucleic acid base or amino acid residue occurs in both sequences to yield the number of matched positions, dividing the number of matched positions by the total number of positions in the window of comparison and multiplying the result by 100 to yield the percentage of sequence identity. Alternatively, the percentage may be calculated by determining the number of positions at which either the identical nucleic acid base or amino acid residue occurs in both sequences or a nucleic acid base or amino acid residue is aligned with a gap to yield the number of matched positions, dividing the number of matched positions by the total number of positions in the window of comparison and multiplying the result by 100 to yield the percentage of sequence identity. Those of skill in the art appreciate that there are many established algorithms available to align two sequences. Optimal alignment of sequences for comparison can be conducted, e.g., by the local homology algorithm of Smith and Waterman (Smith and Waterman, Adv. Appl. Math., 2:482 [1981]), by the homology alignment algorithm of Needleman and Wunsch (Needleman and Wunsch, J. Mol. Biol., 48:443 [1970]), by the search for similarity method of Pearson and Lipman (Pearson and Lipman, Proc. Natl. Acad. Sci. USA 85:2444 [1988]), by computerized implementations of these algorithms (e.g., GAP, BESTFIT, FASTA, and TFASTA in the GCG Wisconsin Software Package), or by visual inspection, as known in the art. Examples of algorithms that are suitable for determining percent sequence identity and sequence similarity include, but are not limited to the BLAST and BLAST 2.0 algorithms (See e.g., Altschul et al., J. Mol. Biol., 215: 403-410 [1990]; and Altschul et al., Nucleic Acids Res., 3389-3402 [1977]). Software for performing BLAST analyses is publicly available through the National Center for Biotechnology Information website. This algorithm involves first identifying high scoring sequence pairs (HSPs) by identifying short words of length "W" in the query sequence, which either match or satisfy some positive-valued threshold score "T," when aligned with a word of the same length in a database sequence. T is referred to as the neighborhood word score threshold (See, Altschul et al, supra). These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters "M" (reward score for a pair of matching residues; always >0) and "N" (penalty score for mismatching residues; always <0). For amino acid sequences, a scoring matrix is used to calculate the cumulative score. Extension of the word hits in each direction are halted when: the cumulative alignment score falls off by the quantity "X" from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, M=5, N=−4, and a comparison of both strands. For amino acid sequences, the BLASTP program uses as defaults a wordlength (W) of 3, an expectation (E) of 10, and the BLOSUM62 scoring matrix (See e.g., Henikoff and Henikoff, Proc. Natl. Acad. Sci. USA 89:10915 [1989]). Exemplary determination of sequence alignment and % sequence identity can employ the BESTFIT or GAP programs in the GCG Wisconsin Software package (Accelrys, Madison Wis.), using default parameters provided.

As used herein, "reference sequence" refers to a defined sequence used as a basis for a sequence comparison. A reference sequence may be a subset of a larger sequence, for example, a segment of a full-length gene or polypeptide sequence. Generally, a reference sequence is at least 20 nucleotide or amino acid residues in length, at least 25 residues in length, at least 50 residues in length, at least 100 residues in length or the full length of the nucleic acid or polypeptide. Since two polynucleotides or polypeptides may each (1) comprise a sequence (i.e., a portion of the complete sequence) that is similar between the two sequences, and (2) may further comprise a sequence that is divergent between the two sequences, sequence comparisons between two (or more) polynucleotides or polypeptide are typically performed by comparing sequences of the two polynucleotides or polypeptides over a "comparison window" to identify and compare local regions of sequence similarity. In some embodiments, a "reference sequence" can be based on a primary amino acid sequence, where the reference sequence is a sequence that can have one or more changes in the primary sequence. For instance, the phrase "a reference sequence based on SEQ ID NO: 6, having a valine at the residue corresponding to X712" (or "a reference sequence based on SEQ ID NO: 6, having a valine at the residue corresponding to position 712") refers to a reference sequence in which the corresponding residue at position X712 in SEQ ID NO: 6 (e.g., an isoleucine), has been changed to valine.

As used herein, "comparison window" refers to a conceptual segment of at least about 20 contiguous nucleotide positions or amino acids residues wherein a sequence may be compared to a reference sequence of at least 20 contiguous nucleotides or amino acids and wherein the portion of the sequence in the comparison window may comprise additions or deletions (i.e., gaps) of 20 percent or less as compared to the reference sequence (which does not comprise additions or deletions) for optimal alignment of the two sequences. The comparison window can be longer than 20 contiguous residues, and includes, optionally 30, 40, 50, 100, or longer windows.

As used herein, "corresponding to", "reference to," and "relative to" when used in the context of the numbering of a given amino acid or polynucleotide sequence refer to the numbering of the residues of a specified reference sequence when the given amino acid or polynucleotide sequence is compared to the reference sequence. In other words, the residue number or residue position of a given polymer is designated with respect to the reference sequence rather than by the actual numerical position of the residue within the given amino acid or polynucleotide sequence. For example, a given amino acid sequence, such as that of an engineered DNA polymerase, can be aligned to a reference sequence by introducing gaps to optimize residue matches between the two sequences. In these cases, although the gaps are present, the numbering of the residue in the given amino acid or polynucleotide sequence is made with respect to the reference sequence to which it has been aligned. In some embodiments, the sequence is tagged (e.g., with a histidine tag).

As used herein, "mutation" refers to the alteration of a nucleic acid sequence. In some embodiments, mutations result in changes to the encoded polypeptide sequence (i.e., as compared to the original sequence without the mutation). In some embodiments, the mutation comprises a substitution, such that a different amino acid is produced (e.g., substitution of an aspartic acid with tryptophan). In some alternative embodiments, the mutation comprises an addition, such that an amino acid is added to the original polypeptide sequence. In some further embodiments, the mutation comprises a deletion, such that an amino acid is deleted from the original polypeptide sequence. Any number of mutations may be present in a given sequence.

As used herein, "amino acid difference" and "residue difference" refer to a difference in the amino acid residue at a position of a polypeptide sequence relative to the amino acid residue at a corresponding position in a reference sequence. The positions of amino acid differences generally are referred to herein as "Xn," where n refers to the corresponding position in the reference sequence upon which the residue difference is based. For example, a "residue difference at position X15 as compared to SEQ ID NO: 824" (or a "residue difference at position 15 as compared to SEQ ID NO: 824") refers to a difference of the amino acid residue at the polypeptide position corresponding to position 15 of SEQ ID NO: 824. Thus, if the reference polypeptide of SEQ ID NO: 824 has an aspartic acid at position 15, then a "residue difference at position X15 as compared to SEQ ID NO: 824" refers to an amino acid substitution of any residue other than aspartic acid at the position of the polypeptide corresponding to position 15 of SEQ ID NO: 824. In most instances herein, the specific amino acid residue difference at a position is indicated as "XnY" where "Xn" specified the corresponding residue and position of the reference polypeptide (as described above), and "Y" is the single letter identifier of the amino acid found in the engineered polypeptide (i.e., the different residue than in the reference polypeptide). In some instances (e.g., in the Tables in the Examples), the present disclosure also provides specific amino acid differences denoted by the conventional notation "AnB", where A is the single letter identifier of the residue in the reference sequence, "n" is the number of the residue position in the reference sequence, and B is the single letter identifier of the residue substitution in the sequence of the engineered polypeptide. In some instances, a polypeptide of the present disclosure can include one or more amino acid residue differences relative to a reference sequence, which is indicated by a list of the specified positions where residue differences are present relative to the reference sequence. In some embodiments, where more than one amino acid can be used in a specific residue position of a polypeptide, the various amino acid residues that can be used are separated by a "/" (e.g., X775F/X775G, X775F/G, or K775F/G). The present disclosure includes engineered polypeptide sequences comprising one or more amino acid differences that include either/or both conservative and non-conservative amino acid substitutions, as well as insertions and deletions of amino acids in the sequence (e.g., deletion at position 784).

As used herein, the terms "amino acid substitution set" and "substitution set" refers to a group of amino acid substitutions within a polypeptide sequence. In some embodiments, substitution sets comprise 1, 2, 3, 4, 5, 6, 7, 8, 9, 10, 11, 12, 13, 14, 15, or more amino acid substitutions. In some embodiments, a substitution set refers to the set of amino acid substitutions that is present in any of the variant DNA polymerase polypeptides listed in any of the Tables in the Examples. In these substitution sets, the individual substitutions are separated by a semicolon (";"; e.g., P567G; I569G;Y667N) or slash ("/"; e.g., P567G/I569G/Y667N). In some embodiments, the "substitution" comprises the deletion of an amino acid.

As used herein, "conservative amino acid substitution" refers to a substitution of a residue with a different residue having a similar side chain, and thus typically involves substitution of the amino acid in the polypeptide with amino acids within the same or similar defined class of amino acids. By way of example and not limitation, an amino acid with an aliphatic side chain may be substituted with another aliphatic amino acid (e.g., alanine, valine, leucine, and isoleucine); an amino acid with hydroxyl side chain is substituted with another amino acid with a hydroxyl side chain (e.g., serine and threonine); an amino acids having aromatic side chains is substituted with another amino acid having an aromatic side chain (e.g., phenylalanine, tyrosine, tryptophan, and histidine); an amino acid with a basic side chain is substituted with another amino acid with a basis side chain (e.g., lysine and arginine); an amino acid with an acidic side chain is substituted with another amino acid with an acidic side chain (e.g., aspartic acid or glutamic acid); and a hydrophobic or hydrophilic amino acid is replaced with another hydrophobic or hydrophilic amino acid, respectively.

As used herein, "non-conservative substitution" refers to substitution of an amino acid in the polypeptide with an amino acid with significantly differing side chain properties. Non-conservative substitutions may use amino acids between, rather than within, the defined groups and affect: (a) the structure of the peptide backbone in the area of the substitution (e.g., proline for glycine); (b) the charge or hydrophobicity; and/or (c) the bulk of the side chain. By way of example and not limitation, exemplary non-conservative substitutions include an acidic amino acid substituted with a basic or aliphatic amino acid; an aromatic amino acid substituted with a small amino acid; and a hydrophilic amino acid substituted with a hydrophobic amino acid.

As used herein, "deletion" refers to modification to the polypeptide by removal of one or more amino acids from the reference polypeptide. Deletions can comprise removal of 1 or more amino acids, 2 or more amino acids, 5 or more amino acids, 10 or more amino acids, 15 or more amino acids, or 20 or more amino acids, up to 10% of the total number of amino acids, or up to 20% of the total number of amino acids making up the reference enzyme while retaining enzymatic activity and/or retaining the improved properties of an engineered polymerase enzyme. Deletions can be directed to the internal portions and/or terminal portions of the polypeptide. In various embodiments, the deletion can comprise a continuous segment or can be discontinuous. Deletions are indicated by "-", and may be present in substitution sets.

As used herein, "insertion" refers to modification to the polypeptide by addition of one or more amino acids from the reference polypeptide. Insertions can be in the internal portions of the polypeptide, or to the carboxy or amino terminus. Insertions as used herein include fusion proteins as is known in the art. The insertion can be a contiguous segment of amino acids or separated by one or more of the amino acids in the naturally occurring polypeptide.

As used herein, "functional fragment" and "biologically active fragment" are used interchangeably herein, to refer to a polypeptide that has an amino-terminal and/or carboxy-terminal deletion(s) and/or internal deletions, but where the remaining amino acid sequence is identical to the corresponding positions in the sequence to which it is being compared (e.g., a full length engineered DNA polymerase of the present invention) and that retains substantially all of the activity of the full-length polypeptide.

As used herein, "isolated polypeptide" refers to a polypeptide which is substantially separated from other contaminants that naturally accompany it (e.g., protein, lipids, and polynucleotides). The term embraces polypeptides which have been removed or purified from their naturally-occurring environment or expression system (e.g., host cell or in vitro synthesis). The recombinant DNA polymerase polypeptides may be present within a cell, present in the cellular medium, or prepared in various forms, such as lysates or isolated preparations. As such, in some embodiments, the recombinant DNA polymerase polypeptides provided herein are isolated polypeptides.

As used herein, "substantially pure polypeptide" refers to a composition in which the polypeptide species is the predominant species present (i.e., on a molar or weight basis it is more abundant than any other individual macromolecular species in the composition), and is generally a substantially purified composition when the object species comprises at least about 50 percent of the macromolecular species present by mole or % weight. Generally, a substantially pure DNA polymerase composition will comprise about 60% or more, about 70% or more, about 80% or more, about 90% or more, about 95% or more, and about 98% or more of all macromolecular species by mole or % weight present in the composition. In some embodiments, the object species is purified to essential homogeneity (i.e., contaminant species cannot be detected in the composition by conventional detection methods) wherein the composition consists essentially of a single macromolecular species. Solvent species, small molecules (<500 Daltons), and elemental ion species are not considered macromolecular species. In some embodiments, the isolated recombinant DNA polymerase polypeptides are substantially pure polypeptide compositions.

As used herein, "improved enzyme property" refers to an engineered DNA polymerase polypeptide that exhibits an improvement in any enzyme property as compared to a reference DNA polymerase polypeptide, such as a wild-type DNA polymerase polypeptide (e.g., the wild-type DNA polymerase of SEQ ID NO: 2) or another engineered DNA polymerase polypeptide. Improved properties include but are not limited to such properties as increased protein expression, increased thermoactivity, increased thermostability, increased stability, increased enzymatic activity, increased substrate specificity and/or affinity, increased specific activity, increased resistance to substrate and/or end-product inhibition, increased chemical stability, improved chemoselectivity, improved solvent stability, increased tolerance to acidic pH, increased tolerance to proteolytic activity (i.e., reduced sensitivity to proteolysis), increased solubility, and altered temperature profile.

As used herein, "increased enzymatic activity" and "enhanced catalytic activity" refer to an improved property of the engineered DNA polymerase polypeptides, which can be represented by an increase in specific activity (e.g., product produced/time/weight protein) and/or an increase in percent conversion of the substrate to the product (e.g., percent conversion of starting amount of substrate to product in a specified time period using a specified amount of DNA polymerase) as compared to the reference DNA polymerase enzyme (e.g., wild-type DNA polymerase and/or another engineered DNA polymerase). Exemplary methods to determine enzyme activity are provided in the Examples. Any property relating to enzyme activity may be affected, including the classical enzyme properties of $K_m$, $V_{max}$ or $k_{cat}$, changes of which can lead to increased enzymatic activity. Improvements in enzyme activity can be from about 1.1 fold the enzymatic activity of the corresponding wild-type enzyme, to as much as 2-fold, 5-fold, 10-fold, 20-fold, 25-fold, 50-fold, 75-fold, 100-fold, 150-fold, 200-fold or more enzymatic activity than the naturally occurring DNA polymerase or another engineered DNA polymerase from which the DNA polymerase polypeptides were derived.

The terms "proteolytic activity" and "proteolysis" used interchangeably herein refer to the breakdown of proteins into smaller polypeptides or amino acids. The breakdown of proteins is generally the result of hydrolysis of the peptide bond by protease (proteinase) enzymes. Protease enzymes include but are not limited to pepsin, trypsin, chymotrypsin, elastase; carboxypeptidase A and B, and peptidases (e.g., amino peptidase, dipeptidase and enteropeptidase).

The phrases "reducing sensitivity to proteolysis" and "reducing proteolytic sensitivity" are used interchangeably herein mean that an engineered DNA polymerase polypeptide according to the invention will have a higher enzyme activity compared to a reference DNA polymerase in a standard assay (e.g., as disclosed in the Examples) after treatment with one or more proteases.

As used herein, "conversion" refers to the enzymatic conversion (or biotransformation) of substrate(s) to the corresponding product(s). "Percent conversion" refers to the percent of the substrate that is converted to the product within a period of time under specified conditions. Thus, the "enzymatic activity" or "activity" of a DNA polymerase polypeptide can be expressed as "percent conversion" of the substrate to the product in a specific period of time.

As used herein, "hybridization stringency" relates to hybridization conditions, such as washing conditions, in the hybridization of nucleic acids. Generally, hybridization reactions are performed under conditions of lower stringency, followed by washes of varying but higher stringency. The term "moderately stringent hybridization" refers to conditions that permit target-DNA to bind a complementary nucleic acid that has about 60% identity, preferably about 75% identity, about 85% identity to the target DNA, with greater than about 90% identity to target-polynucleotide.

Exemplary moderately stringent conditions are conditions equivalent to hybridization in 50% formamide, 5×Denhart's solution, 5×SSPE, 0.2% SDS at 42° C., followed by washing in 0.2×SSPE, 0.2% SDS, at 42° C. "High stringency hybridization" refers generally to conditions that are about 10° C. or less from the thermal melting temperature $T_m$ as determined under the solution condition for a defined polynucleotide sequence. In some embodiments, a high stringency condition refers to conditions that permit hybridization of only those nucleic acid sequences that form stable hybrids in 0.018M NaCl at 65° C. (i.e., if a hybrid is not stable in 0.018M NaCl at 65° C., it will not be stable under high stringency conditions, as contemplated herein). High stringency conditions can be provided, for example, by hybridization in conditions equivalent to 50% formamide, 5×Denhart's solution, 5×SSPE, 0.2% SDS at 42° C., followed by washing in 0.1×SSPE, and 0.1% SDS at 65° C. Another high stringency condition comprises hybridizing in conditions equivalent to hybridizing in 5×SSC containing 0.1% (w:v) SDS at 65° C. and washing in 0.1×SSC containing 0.1% SDS at 65° C. Other high stringency hybridization conditions, as well as moderately stringent conditions, are described in the references cited above.

As used herein, "codon optimized" refers to changes in the codons of the polynucleotide encoding a protein to those preferentially used in a particular organism such that the encoded protein is more efficiently expressed in that organism. Although the genetic code is degenerate, in that most amino acids are represented by several codons, called "synonyms" or "synonymous" codons, it is well known that codon usage by particular organisms is nonrandom and biased towards particular codon triplets. This codon usage bias may be higher in reference to a given gene, genes of common function or ancestral origin, highly expressed proteins versus low copy number proteins, and the aggregate protein coding regions of an organism's genome. In some embodiments, the polynucleotides encoding the DNA polymerase enzymes are codon optimized for optimal production from the host organism selected for expression.

As used herein, "control sequence" refers herein to include all components that are necessary or advantageous for the expression of a polynucleotide and/or polypeptide of the present disclosure. Each control sequence may be native or foreign to the nucleic acid sequence encoding the polypeptide. Such control sequences include, but are not limited to, leaders, polyadenylation sequences, propeptide sequences, promoter sequences, signal peptide sequences, initiation sequences, and transcription terminators. At a minimum, the control sequences include a promoter, and transcriptional and translational stop signals. In some embodiments, the control sequences are provided with linkers for the purpose of introducing specific restriction sites facilitating ligation of the control sequences with the coding region of the nucleic acid sequence encoding a polypeptide.

"Operably linked" is defined herein as a configuration in which a control sequence is appropriately placed (i.e., in a functional relationship) at a position relative to a polynucleotide of interest such that the control sequence directs or regulates the expression of the polynucleotide encoding a polypeptide of interest.

As used herein, "promoter sequence" refers to a nucleic acid sequence that is recognized by a host cell for expression of a polynucleotide of interest, such as a coding sequence. The promoter sequence contains transcriptional control sequences that mediate the expression of a polynucleotide of interest. The promoter may be any nucleic acid sequence which shows transcriptional activity in the host cell of choice including mutant, truncated, and hybrid promoters, and may be obtained from genes encoding extracellular or intracellular polypeptides either homologous or heterologous to the host cell.

As used herein, "suitable reaction conditions" refers to those conditions in the enzymatic conversion reaction solution (e.g., ranges of enzyme loading, substrate loading, temperature, pH, buffers, co-solvents, etc.) under which a DNA polymerase polypeptide of the present disclosure is capable of converting a substrate to the desired product compound, Exemplary "suitable reaction conditions" are provided herein (See, the Examples).

As used herein, "loading", such as in "compound loading" or "enzyme loading" refers to the concentration or amount of a component in a reaction mixture at the start of the reaction. "Substrate" in the context of an enzymatic conversion reaction process refers to the compound or molecule acted on by the DNA polymerase polypeptide.

As used herein, "product" in the context of an enzymatic conversion process refers to the compound or molecule resulting from the action of the DNA polymerase polypeptide on the substrate.

As used herein, "culturing" refers to the growing of a population of microbial cells under suitable conditions using any suitable medium (e.g., liquid, gel, or solid).

Recombinant polypeptides (e.g., DNA polymerase enzyme variants) can be produced using any suitable methods known the art. For example, there is a wide variety of different mutagenesis techniques well known to those skilled in the art. In addition, mutagenesis kits are also available from many commercial molecular biology suppliers. Methods are available to make specific substitutions at defined amino acids (site-directed), specific or random mutations in a localized region of the gene (regio-specific), or random mutagenesis over the entire gene (e.g., saturation mutagenesis). Numerous suitable methods are known to those in the art to generate enzyme variants, including but not limited to site-directed mutagenesis of single-stranded DNA or double-stranded DNA using PCR, cassette mutagenesis, gene synthesis, error-prone PCR, shuffling, and chemical saturation mutagenesis, or any other suitable method known in the art. Non-limiting examples of methods used for DNA and protein engineering are provided in the following patents: U.S. Pat. Nos. 6,117,679; 6,420,175; 6,376,246; 6,586, 182; 7,747,391; 7,747,393; 7,783,428; and 8,383,346. After the variants are produced, they can be screened for any desired property (e.g., high or increased activity, or low or reduced activity, increased thermal activity, increased thermal stability, and/or acidic pH stability, etc.). In some embodiments, "recombinant DNA polymerase polypeptides" (also referred to herein as "engineered DNA polymerase polypeptides," "engineered DNA polymerases," "variant DNA polymerase enzymes," and "DNA polymerase variants") find use.

As used herein, a "vector" is a DNA construct for introducing a DNA sequence into a cell. In some embodiments, the vector is an expression vector that is operably linked to a suitable control sequence capable of effecting the expression in a suitable host of the polypeptide encoded in the DNA sequence. In some embodiments, an "expression vector" has a promoter sequence operably linked to the DNA sequence (e.g., transgene) to drive expression in a host cell, and in some embodiments, also comprises a transcription terminator sequence.

As used herein, the term "expression" includes any step involved in the production of the polypeptide including, but not limited to, transcription, post-transcriptional modification, translation, and post-translational modification. In some embodiments, the term also encompasses secretion of the polypeptide from a cell.

As used herein, the term "produces" refers to the production of proteins and/or other compounds by cells. It is intended that the term encompass any step involved in the production of polypeptides including, but not limited to, transcription, post-transcriptional modification, translation, and post-translational modification. In some embodiments, the term also encompasses secretion of the polypeptide from a cell.

As used herein, an amino acid or nucleotide sequence (e.g., a promoter sequence, signal peptide, terminator sequence, etc.) is "heterologous" to another sequence with which it is operably linked if the two sequences are not associated in nature.

As used herein, the terms "host cell" and "host strain" refer to suitable hosts for expression vectors comprising DNA provided herein (e.g., a polynucleotide sequences encoding at least one DNA polymerase variant). In some embodiments, the host cells are prokaryotic or eukaryotic cells that have been transformed or transfected with vectors constructed using recombinant DNA techniques as known in the art.

As used herein, the term "analogue" means a polypeptide having more than 70% sequence identity but less than 100% sequence identity (e.g., more than 75%, 78%, 80%, 83%, 85%, 88%, 90%, 91%, 92%, 93%, 94%, 95%, 96%, 97%, 98%, 99% sequence identity) with a reference polypeptide. In some embodiments, analogues include non-naturally occurring amino acid residues including, but not limited, to homoarginine, ornithine and norvaline, as well as naturally occurring amino acids. In some embodiments, analogues also include one or more D-amino acid residues and non-peptide linkages between two or more amino acid residues.

As used herein, the term "effective amount" means an amount sufficient to produce the desired result. One of general skill in the art may determine what the effective amount by using routine experimentation.

The terms "isolated" and "purified" are used to refer to a molecule (e.g., an isolated nucleic acid, polypeptide, etc.) or other component that is removed from at least one other component with which it is naturally associated. The term "purified" does not require absolute purity, rather it is intended as a relative definition.

As used herein, "composition" and "formulation" encompass products comprising at least one As used herein, "cell-free DNA" refers to DNA circulating freely in the bloodstream and is not contained by or associated with cells. In some embodiments, cell-free DNA comprises DNA originally derived and released from normal somatic or germ line cells, cancer cells, fetal cells, microbial cells, or viruses.

As used herein, "amplification" refers to nucleic acid replication. In some embodiments, the term refers to replication of specific template nucleic acid.

As used herein, "polymerase chain reaction" and "PCR" refer to the methods described in U.S. Pat. Nos. 4,683,195 and 4,6884,202, hereby incorporated by reference. These methods find use in increasing the concentration of a segment of a target sequence or an entire target sequence in a mixture or purified DNA, without cloning or purification being required. The sequence of denaturation, annealing and extension constitute a "cycle." The steps of denaturing, primer annealing, and polymerase extension can be repeated many times (i.e., multiple cycles are used), to obtain a high concentration of amplified DNA. The process is well-known in the art and numerous variations have been developed over the years since the method was first described. With PCR, it is possible to amplify a single copy of a specific target sequence to a level that is detectable by several different methodologies, including but not limited to hybridization with a labeled probe, incorporation of biotinylated primers followed by avidin-enzyme conjugate detection, incorporation of $^{32}$P-labeled deoxyribonucleotide triphosphates (e.g., dCTP or dATP) into the amplified segment, etc. In addition to genomic DNA, any oligonucleotide sequence amenable to amplification can be copies using PCR with an appropriate set of primers. PCR products can also serve as templates for amplification.

As used herein, "target" when used in reference to PCR, refers to the region of nucleic acid bounded by the primers used in the PCR method. The "target" is sorted out from other nucleic acids present in the sample used in the PCR method. A "segment" is a region of nucleic acid within the target sequence.

As used herein, "sample template" refers to nucleic acid originating from a sample which is analyzed for the presence of target nucleic acid. In contrast, "background template" refers to nucleic acid other than sample template that may or may not be present within a sample. Background template may be inadvertently included in the sample, it may result from carryover, or may be due to the presence of nucleic acid contaminants from which the target nucleic acid is purified. For example, in some embodiments, nucleic acids from organisms other than those to be detected may be present as background in a test sample. However, it is not intended that the present invention be limited to any specific nucleic acid samples or templates.

As used herein, "amplifiable nucleic acid" is used in reference to nucleic acids which may be amplified by any amplification method, including but not limited to PCR. In most embodiments, amplifiable nucleic acids comprise sample templates.

As used herein, "PCR product", "PCR fragment," and "amplification product" refer to the resultant compounds obtained after two or more cycles of PCR amplification (or other amplification method, as indicated by the context), typically comprising the steps of denaturation, annealing, and extension. The terms encompass the situation wherein there has been amplification of one or more segments of one or more target sequences.

As used herein, "amplification reagents" and "PCR reagents" refer to those reagents (e.g., deoxyribonucleotide triphosphates, buffer, etc.), needed for amplification except for the primers, nucleic acid template, and the amplification enzyme. Typically, amplification reagents, along with other reaction components are placed and contained in a reaction vessel (e.g., test tube, microwell, etc.). It is not intended that the present invention be limited to any specific amplification reagents, as any suitable reagents find use in the present invention.

As used herein, "restriction endonuclease" and "restriction enzyme" refer to enzymes that cut double-stranded nucleic acids at or near a specific nucleotide sequence (i.e., a "restriction site"). In some embodiments, the restriction enzyme is a bacterial enzyme and in some additional embodiments, the nucleic acid is DNA.

As used herein, "primer" refers to an oligonucleotide (i.e., a sequence of nucleotides), whether occurring naturally or produced synthetically, recombinantly, or by amplification, which is capable of acting as a point of initiation of nucleic acid synthesis, when placed under conditions in which synthesis of a primer extension product that is complementary to a nucleic acid strand is induced (i.e., in the presence of nucleotides and an inducing agent such as DNA polymerase, and at a suitable temperature and pH). In most embodiments, primers a single-stranded, but in some embodiments, they are double-stranded. In some embodiments, the primers are of sufficient length to prime the synthesis of extension products in the presence of DNA polymerase. The exact primer length depends upon many factors, as known to those skilled in the art.

As used herein, "probe" refers to an oligonucleotide (i.e., a sequence of nucleotides), whether occurring naturally or produced synthetically, recombinantly, or by amplification, which is capable of hybridizing to another oligonucleotide of interest. Probes find use in the detection, identification, and/or isolation of particular gene sequences of interest. In some embodiments, probes are labeled with a "reporter molecule" (also referred to as a "label") that aids in the detection of the probe in a suitable detection system (e.g., fluorescent, radioactive, luminescent, enzymatic, and other systems). It is not intended that the present invention be limited to any particular detection system or label. Primers, deoxyribonucleotides, and deoxyribonucleosides may contain labels. Indeed, it is not intended that the labeled composition of the present invention be limited to any particular component. Illustrative labels include, but are not limited to $^{32}$P, $^{35}$S, and fluorescent molecules (e.g., fluorescent dyes, including but not limited to green fluorescent protein).

As used herein, "fidelity," when used in reference to a polymerase is intended to refer to the accuracy of template-directed incorporation of complementary bases in a synthesized DNA strand relative to the template strand. Typically, fidelity is measured based on the frequency of incorporation of incorrect bases in the newly synthesized nucleic acid strand. The incorporation of incorrect bases can result in point mutations, insertions, or deletions. Fidelity can be calculated according to any method known in the art (See e.g., Tindall and Kunkel, Biochem., 27:6008-6013 [1988]; and Barnes, Gene 112:29-35 [1992]). A polymerase or polymerase variant can exhibit either high fidelity or low fidelity. As used herein, "high fidelity" refers to polymerases with a frequency of accurate base incorporation that exceeds a predetermined value. As used herein, the term "low fidelity" refers to polymerases with a frequency of accurate base incorporation that is lower than a predetermined value. In some embodiments, the predetermined value is a desired frequency of accurate base incorporation or the fidelity of a known polymerase (i.e., a reference polymerase).

As used herein, "altered fidelity" refers to the fidelity of a polymerase variant that differs from the fidelity of the parent polymerase from which the polymerase variant was derived. In some embodiments, the altered fidelity is higher than the fidelity of the parent polymerase, while in some other embodiments, the altered fidelity is lower than the fidelity of the parent polymerase. Altered fidelity can be determined by assaying the parent and variant polymerases and comparing their activities using any suitable assay known in the art.

As used herein, the term "ligase" refers to a class of enzymes that is commonly used to join polynucleotides together or to join the ends of a single polynucleotide. Ligases include ATP-dependent double-strand polynucleotide ligases, NAD$^+$-dependent double-strand DNA or RNA ligases and single-strand polynucleotide ligases. In some embodiments, the present invention provides bacteriophage ligases (e.g., T3 DNA ligase, T4 DNA ligase, and T7 DNA ligase) and variants thereof. In some further embodiments, the present invention provides fusion or chimeric ligases.

DNA ligases often find use with restriction enzymes for the insertion of DNA fragments (e.g., genes) into plasmids. For ligation of cohesive-ended fragments, controlling the optimal temperature is important in performing efficient recombination. T4 DNA ligase is most active at 37° C., but for optimal ligation efficiency with cohesive-ended fragments, the optimal temperature for the enzyme must be balanced with the melting temperature of the ends being ligated; the shorter the overhang, the lower the melting temperature of the fragments. Ligation reactions tend to be most efficient when the cohesive ends are already stably annealed. For ligation of blunt-ended DNA fragments, the melting temperature is not a factor to take into consideration when the reaction occurs within the normal temperature ranges used for ligation. In these reactions, the limiting factor is the number of alignments between DNA fragment ends that can occur, rather than the ligase activity. Thus, the most efficient temperature for ligation of blunt-ended DNA fragments is the temperature at which the greatest number of alignments can occur in the reaction.

As used herein, the term "adapter" refers to a single or double-stranded oligonucleotide with compatible DNA ends for ligation. The ends of an adapter may be single or double-stranded, and may contain overhangs compatible with complementary overhangs on processed library insert DNA. Adapters may have both single-stranded and double-stranded regions. In some embodiments, the term "adapter" is used to refer to full-length adapters used in NGS (i.e., next-generation sequencing) reactions which may include primer biding sites, barcodes and other features, as well as referring to simplified model adapters used in HTP screening and ligation assays, having the same ligation-compatible ends as full-length adapters, but lacking these additional features. NGS adapters designed for use on the Illumina® sequencing platform have deoxythymidine 3' overhangs compatible for ligation with deoxyadenosine 3' overhangs present on A-tailed insert fragments. T-tailed adapters are not efficiently ligated to one another due to the selectivity of wild-type T4 DNA ligase against non-complementary DNA ends. Adapter dimerization will occur as a result of extreme ligation conditions including long incubation periods, high adapter concentrations, or high concentrations of crowding agent. Importantly, nuclease contaminants in the ligation reaction can remove overhangs on the adaptor ends, resulting in blunt-ended substrates, which are compatible for self-ligation.

As used herein, the term "compatible ends" refers to the ends of two DNA duplex fragments with 5' or 3' overhangs that hybridize in a 5' to 3' antiparallel orientation, such that all bases on the overhangs are complementary. In the context of ligation, at least one DNA fragment must have a 5' phosphate on a nucleotide that is placed adjacent to a 3' hydroxyl of a nucleotide from another molecule upon hybridization of the 3' or 5' overhang. Ligation results in the covalent linkage of the two substrate molecules at the compatible ends. In some embodiments involving library preparation for DNA sequencing, two DNA molecules such as an adapter and an insert fragment must have compatible ends, and both strands of the adapter/insert hybrid must be ligated in order to enable productive library amplification via PCR or sequencing via polymerase extension of a primer hybridized to the adapter.

As used herein, the term "overhang" refers to a region of one or more unpaired polynucleotides occurring at the end of a double-stranded DNA fragment. Either a 5' or a 3' DNA end can be present in the unpaired region. The double-stranded DNA fragment can be a duplex of two complementary single-stranded polynucleotides, or it may be a single polynucleotide with self-complementarity that forms a region of double-stranded DNA.

The term "subject" encompasses mammals such as humans, non-human primates, livestock, companion animals, and laboratory animals (e.g., rodents and lagamorphs). It is intended that the term encompass females as well as males.

As used herein, the term "patient" means any subject that is being assessed for, treated for, or is experiencing disease.

Engineered DNA Polymerase Polypeptides:

When a particular DNA polymerase variant (i.e., an engineered DNA polymerase polypeptide) is referred to by reference to modification of particular amino acids residues in the sequence of a wild-type DNA polymerase or reference DNA polymerase, it is to be understood that variants of another DNA polymerase modified in the equivalent position(s) (as determined from the optional amino acid sequence alignment between the respective amino acid sequences) are encompassed herein.

The engineered DNA polymerase polypeptide variants of the present invention perform polymerase reactions, including those useful in the polymerase chain reaction (PCR) and other reactions that utilize polymerase to produce DNA.

The engineered DNA polymerase variants of the present invention find use in the efficient creation of DNA libraries suitable for NGS and other diagnostic methods. These DNA polymerase variants find use in solution, as well as in immobilized embodiments.

In some additional embodiments, the engineered DNA polymerase polypeptide of the present invention comprises a polypeptide comprising at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to SEQ ID NO: 2, 6, 22, 24, 26, 28, and/or 824.

In some embodiments, engineered DNA polymerase polypeptides are produced by cultivating a microorganism comprising at least one polynucleotide sequence encoding at least one engineered DNA polymerase polypeptide under conditions which are conducive for producing the engineered DNA polymerase polypeptide. In some embodiments, the engineered DNA polymerase polypeptide is subsequently recovered from the resulting culture medium and/or cells.

The present invention provides exemplary engineered DNA polymerase polypeptides having DNA polymerase activity. The Examples provide Tables showing sequence structural information correlating specific amino acid sequence features with the functional activity of the engineered DNA polymerase polypeptides. This structure-function correlation information is provided in the form of specific amino acid residue differences relative to the reference engineered polypeptide of SEQ ID NO: 2, 6, 22, 24, 26, 28, and/or 824, as well as associated experimentally determined activity data for the exemplary engineered DNA polymerase polypeptides.

In some embodiments, the engineered DNA polymerase polypeptides of the present invention having DNA polymerase activity comprise an amino acid sequence having at least 85% sequence identity to reference sequence SEQ ID NO: 2, 6, 22, 24, 26, 28, and/or 824, and which exhibits at least one improved property, as compared to the reference sequence (e.g., wild-type DNA polymerase). In some embodiments, the improved property is increased product produced during PCR, while in some additional embodiments, the improved property is increased fidelity, and in still some additional embodiments, the improved property is increased thermostability.

In some embodiments the engineered DNA polymerase polypeptides exhibiting at least one improved property have at least 85%, at least 88%, at least 90%, at least 91%, at least 92%, at least 93%, at least 94%, at least 95%, at least 96%, at least 97%, at least 98%, at least 99% or greater amino acid sequence identity with SEQ ID NO: 2, 6, 22, 24, 26, 28, and/or 824, and an amino acid residue difference at one or more amino acid positions (such as at 1, 2, 3, 4, 5, 6, 7, 8, 9, 10, 11, 12, 14, 15, 20 or more amino acid positions) compared to SEQ ID NO: 2, 6, 22, 24, 26, 28, and/or 824. In some embodiments, the engineered DNA polymerase polypeptide is a polypeptide listed in the Tables provided in the Examples (e.g., Table 3.1, 3.2, 3.3. 3.4, 3.5, 3.6, 3.7, 3.8, 4.1, 4.2, 4.3, 4.4, 4.5, 6.2, and/or 6.3).

In some embodiments, the present invention provides functional fragments of engineered DNA polymerase polypeptides. In some embodiments, functional fragments comprise at least about 90%, at least about 95%, at least about 96%, at least about 97%, at least about 98%, or at least about 99% of the activity of the engineered DNA polymerase polypeptide from which it was derived (i.e., the parent engineered DNA polymerase). In some embodiments, functional fragments comprise at least about 90%, at least about 91%, at least about 92%, at least about 93%, at least about 94%, at least about 95%, at least about 96%, at least about 97%, at least about 98%, or at least about 99% of the parent sequence of the engineered DNA polymerase. In some embodiments the functional fragment will be truncated by less than 5, less than 10, less than 15, less than 10, less than 25, less than 30, less than 35, less than 40, less than 45, and less than 50 amino acids.

In some embodiments, the present invention provides functional fragments of engineered DNA polymerase polypeptides. In some embodiments, functional fragments comprise at least about 95%, 96%, 97%, 98%, or 99% of the activity of the engineered DNA polymerase polypeptide from which it was derived (i.e., the parent engineered DNA polymerase). In some embodiments, functional fragments comprise at least 90%, 91%, 92%, 93%, 94%, 95%, 96%, 97%, 98%, or 99% of the parent sequence of the engineered DNA polymerase. In some embodiments the functional fragment will be truncated by less than 5, less than 10, less than 15, less than 10, less than 25, less than 30, less than 35, less than 40, less than 45, less than 50, less than 55, less than 60, less than 65, or less than 70 amino acids.

In some embodiments, the engineered DNA polymerase polypeptides exhibiting at least one improved property have at least 85%, at least 88%, at least 90%, at least 91%, at least 92%, at least 93%, at least 94%, at least 95%, at least 96%, at least 97%, at least 98%, at least 99%, or greater amino acid sequence identity with SEQ ID NO: 2, 6, 22, 24, 26, 28, and/or 824, and an amino acid residue difference at one or more amino acid positions (such as at 1, 2, 3, 4, 5, 6, 7, 8, 9, 10, 11, 12, 14, 15 or more amino acid positions) compared to SEQ ID NO: 2, 6, 22, 24, 26, 28, and/or 824. In some embodiments, the engineered DNA polymerases comprise at least 90% sequence identity to SEQ ID NO: 2, 6, 22, 24, 26, 28, and/or 824, and comprise an amino acid difference of at least 1, 2, 3, 4, 5, 6, 7, 8, 9, 10 or more amino acid positions. In some embodiments, the engineered DNA polymerase polypeptide consists of the sequence of SEQ ID NO: 6, 22, 24, 26, 28, and/or 824.

Polynucleotides Encoding Engineered Polypeptides, Expression Vectors and Host Cells:

The present invention provides polynucleotides encoding the engineered DNA polymerase polypeptides described herein. In some embodiments, the polynucleotides are operatively linked to one or more heterologous regulatory sequences that control gene expression to create a recombinant polynucleotide capable of expressing the polypeptide. In some embodiments, expression constructs containing at least one heterologous polynucleotide encoding the engineered DNA polymerase polypeptide(s) is introduced into appropriate host cells to express the corresponding DNA polymerase polypeptide(s).

As will be apparent to the skilled artisan, availability of a protein sequence and the knowledge of the codons corresponding to the various amino acids provide a description of all the polynucleotides capable of encoding the subject polypeptides. The degeneracy of the genetic code, where the same amino acids are encoded by alternative or synonymous codons, allows an extremely large number of nucleic acids to be made, all of which encode an engineered DNA polymerase polypeptide. Thus, the present invention provides methods and compositions for the production of each and every possible variation of DNA polymerase polynucleotides that could be made that encode the DNA polymerase polypeptides described herein by selecting combinations based on the possible codon choices, and all such variations are to be considered specifically disclosed for any polypeptide described herein, including the amino acid sequences presented in the Examples (e.g., in Table 3.1, 3.2, 3.3. 3.4, 3.5, 3.6, 3.7, 3.8, 4.1, 4.2, 4.3, 4.4, and/or 4.5).

In some embodiments, the codons are preferably optimized for utilization by the chosen host cell for protein production. For example, preferred codons used in bacteria are typically used for expression in bacteria. Consequently, codon optimized polynucleotides encoding the engineered DNA polymerase polypeptides contain preferred codons at about 40%, 50%, 60%, 70%, 80%, 90%, or greater than 90% of the codon positions in the full length coding region.

In some embodiments, the DNA polymerase polynucleotide encodes an engineered polypeptide having DNA polymerase activity with the properties disclosed herein, wherein the polypeptide comprises an amino acid sequence having at least 80%, 85%, 86%, 87%, 88%, 89%, 90%, 91%, 92%, 93%, 94%, 95%, 96%, 97%, 98%, 99% or more identity to a reference sequence selected from SEQ ID NO: 2, 6, 22, 24, 26, 28, and/or 824, or the amino acid sequence of any variant (e.g., those provided in the Examples), and one or more residue differences as compared to the reference polynucleotide of SEQ ID NO: 2, 6, 22, 24, 26, 28, and/or 824, or the amino acid sequence of any variant as disclosed in the Examples (for example 1, 2, 3, 4, 5, 6, 7, 8, 9, 10 or more amino acid residue positions). In some embodiments, the reference sequence is selected from SEQ ID NO: 2, 6, 22, 24, 26, 28, and/or 824. In some embodiments, the engineered DNA polymerase variants comprise a polypeptide sequence set forth in SEQ ID NO: 6, 22, 24, 26, 28, and/or 824. In some embodiments, the engineered DNA polymerase variants comprise the substitution(s) or substitution set(s) of variant DNA polymerases provided in the Examples.

The present invention provides polynucleotides encoding the engineered DNA polymerase variants provided herein. In some embodiments, the polynucleotides comprise a nucleotide sequence having at least 80%, 85%, 86%, 87%, 88%, 89%, 90%, 91%, 92%, 93%, 94%, 95%, 96%, 97%, 98%, 99% or more identity to a reference sequence selected from SEQ ID NO: 1, 5, 21, 23, 25, 27, and/or 823, or the nucleic acid sequence of any variant (e.g., those provided in the Examples), and one or more residue differences as compared to the reference polynucleotide of SEQ ID NO: 1, 5, 21, 23, 25, 27, and/or 823, or the nucleic acid sequence of any variant as disclosed in the Examples (for example 1, 2, 3, 4, 5, 6, 7, 8, 9, 10 or more positions). In some embodiments, the reference sequence is selected from SEQ ID NO: 1, 5, 21, 23, 25, 27, and/or 823. In some embodiments, the polynucleotides are capable of hybridizing under highly stringent conditions to a reference polynucleotide sequence selected from SEQ ID NO: 1, 5, 21, 23, 25, 27, and/or 823, or a complement thereof, or a polynucleotide sequence encoding any of the variant DNA polymerase polypeptides provided herein. In some embodiments, the polynucleotide capable of hybridizing under highly stringent conditions encodes a DNA polymerase polypeptide comprising an amino acid sequence that has one or more residue differences as compared to SEQ ID NO: 2, 22, 24, 26, 28, and/or 824. In some embodiments, the engineered DNA polymerase variants are encoded by a polynucleotide sequence set forth in SEQ ID NO: 1, 5, 21, 23, 25, 27, and/or 823.

In some embodiments, an isolated polynucleotide encoding any of the engineered DNA polymerase polypeptides herein is manipulated in a variety of ways to facilitate expression of the DNA polymerase polypeptide. In some embodiments, the polynucleotides encoding the DNA polymerase polypeptides comprise expression vectors where one or more control sequences is present to regulate the expression of the DNA polymerase polynucleotides and/or polypeptides. Manipulation of the isolated polynucleotide prior to its insertion into a vector may be desirable or necessary depending on the expression vector utilized. Techniques for modifying polynucleotides and nucleic acid sequences utilizing recombinant DNA methods are well known in the art. In some embodiments, the control sequences include among others, promoters, leader sequences, polyadenylation sequences, propeptide sequences, signal peptide sequences, and transcription terminators. In some embodiments, suitable promoters are selected based on the host cells selection. For bacterial host cells, suitable promoters for directing transcription of the nucleic acid constructs of the present disclosure, include, but are not limited to promoters obtained from the *E. coli* lac operon, *Streptomyces coelicolor* agarase gene (dagA), *Bacillus subtilis* levansucrase gene (sacB), *Bacillus licheniformis* alpha-amylase gene (amyL), *Bacillus stearothermophilus* maltogenic amylase gene (amyM), *Bacillus amyloliquefaciens* alpha-amylase gene (amyQ), *Bacillus licheniformis* penicillinase gene (penP), *Bacillus subtilis* xylA and xylB genes, and prokaryotic beta-lactamase gene (See e.g., Villa-Kamaroff et al., Proc. Natl Acad. Sci. USA 75: 3727-3731 [1978]), as well as the tac promoter (See e.g., DeBoer et al., Proc. Natl Acad. Sci. USA 80: 21-25 [1983]). Exemplary promoters for filamentous fungal host cells, include, but are not limited to promoters obtained from the genes for *Aspergillus oryzae* TAKA amylase, *Rhizomucor miehei* aspartic proteinase, *Aspergillus niger* neutral alpha-amylase, *Aspergillus niger* acid stable alpha-amylase, *Aspergillus niger* or *Aspergillus awamori* glucoamylase (glaA), *Rhizomucor miehei* lipase, *Aspergillus oryzae* alkaline protease, *Aspergillus oryzae* triose phosphate isomerase, *Aspergillus nidulans* acetamidase, and *Fusarium oxysporum* trypsin-like protease (See e.g., WO 96/00787), as well as the NA2-tpi promoter (a hybrid of the promoters from the genes for *Aspergillus niger* neutral alpha-amylase and *Aspergillus oryzae* triose phosphate isomerase), and mutant, truncated, and hybrid promoters thereof. Exemplary yeast cell promoters can be from the genes can be from the genes for *Saccharomyces cerevisiae* enolase (ENO-1), *Saccharomyces cerevisiae* galactokinase (GAL1), *Saccharomyces cerevisiae* alcohol dehydrogenase/glyceraldehyde-3-phosphate dehydrogenase (ADH2/GAP), and *Saccharomyces cerevisiae* 3-phosphoglycerate kinase. Other useful promoters for yeast host cells are known in the art (See e.g., Romanos et al., Yeast 8:423-488 [1992]).

In some embodiments, the control sequence is also a suitable transcription terminator sequence (i.e., a sequence recognized by a host cell to terminate transcription). In some embodiments, the terminator sequence is operably linked to the 3' terminus of the nucleic acid sequence encoding the DNA polymerase polypeptide. Any suitable terminator which is functional in the host cell of choice finds use in the present invention. Exemplary transcription terminators for filamentous fungal host cells can be obtained from the genes for *Aspergillus oryzae* TAKA amylase, *Aspergillus niger* glucoamylase, *Aspergillus nidulans* anthranilate synthase, *Aspergillus niger* alpha-glucosidase, and *Fusarium oxysporum* trypsin-like protease. Exemplary terminators for yeast host cells can be obtained from the genes for *Saccharomyces cerevisiae* enolase, *Saccharomyces cerevisiae* cytochrome C (CYC1), and *Saccharomyces cerevisiae* glyceraldehyde-3-phosphate dehydrogenase. Other useful terminators for yeast host cells are known in the art (See e.g., Romanos et al., supra).

In some embodiments, the control sequence is also a suitable leader sequence (i.e., a non-translated region of an mRNA that is important for translation by the host cell). In some embodiments, the leader sequence is operably linked to the 5' terminus of the nucleic acid sequence encoding the DNA polymerase polypeptide. Any suitable leader sequence that is functional in the host cell of choice find use in the present invention. Exemplary leaders for filamentous fungal host cells are obtained from the genes for *Aspergillus oryzae* TAKA amylase, and *Aspergillus nidulans* triose phosphate isomerase. Suitable leaders for yeast host cells are obtained from the genes for *Saccharomyces cerevisiae* enolase (ENO-1), *Saccharomyces cerevisiae* 3-phosphoglycerate kinase, *Saccharomyces cerevisiae* alpha-factor, and *Saccharomyces cerevisiae* alcohol dehydrogenase/glyceraldehyde-3-phosphate dehydrogenase (ADH2/GAP).

In some embodiments, the control sequence is also a polyadenylation sequence (i.e., a sequence operably linked to the 3' terminus of the nucleic acid sequence and which, when transcribed, is recognized by the host cell as a signal to add polyadenosine residues to transcribed mRNA). Any suitable polyadenylation sequence which is functional in the host cell of choice finds use in the present invention. Exemplary polyadenylation sequences for filamentous fungal host cells include, but are not limited to the genes for *Aspergillus oryzae* TAKA amylase, *Aspergillus niger* glucoamylase, *Aspergillus nidulans* anthranilate synthase, *Fusarium oxysporum* trypsin-like protease, and *Aspergillus niger* alpha-glucosidase. Useful polyadenylation sequences for yeast host cells are known (See e.g., Guo and Sherman, Mol. Cell. Biol., 15:5983-5990 [1995]).

In some embodiments, the control sequence is also a signal peptide (i.e., a coding region that codes for an amino acid sequence linked to the amino terminus of a polypeptide and directs the encoded polypeptide into the cell's secretory pathway). In some embodiments, the 5' end of the coding sequence of the nucleic acid sequence inherently contains a signal peptide coding region naturally linked in translation reading frame with the segment of the coding region that encodes the secreted polypeptide. Alternatively, in some embodiments, the 5' end of the coding sequence contains a signal peptide coding region that is foreign to the coding sequence. Any suitable signal peptide coding region which directs the expressed polypeptide into the secretory pathway of a host cell of choice finds use for expression of the engineered polypeptide(s). Effective signal peptide coding regions for bacterial host cells are the signal peptide coding regions include, but are not limited to those obtained from the genes for *Bacillus* NC1B 11837 maltogenic amylase, *Bacillus stearothermophilus* alpha-amylase, *Bacillus licheniformis* subtilisin, *Bacillus licheniformis* beta-lactamase, *Bacillus stearothermophilus* neutral proteases (nprT, nprS, nprM), and *Bacillus subtilis* prsA. Further signal peptides are known in the art (See e.g., Simonen and Palva, Microbiol. Rev., 57:109-137 [1993]). In some embodiments, effective signal peptide coding regions for filamentous fungal host cells include, but are not limited to the signal peptide coding regions obtained from the genes for *Aspergillus oryzae* TAKA amylase, *Aspergillus niger* neutral amylase, *Aspergillus niger* glucoamylase, *Rhizomucor miehei* aspartic proteinase, *Humicola insolens* cellulase, and *Humicola lanuginosa* lipase. Useful signal peptides for yeast host cells include, but are not limited to those from the genes for *Saccharomyces cerevisiae* alpha-factor and *Saccharomyces cerevisiae* invertase.

In some embodiments, the control sequence is also a propeptide coding region that codes for an amino acid sequence positioned at the amino terminus of a polypeptide. The resultant polypeptide is referred to as a "proenzyme," "propolypeptide," or "zymogen." A propolypeptide can be converted to a mature active polypeptide by catalytic or autocatalytic cleavage of the propeptide from the propolypeptide. The propeptide coding region may be obtained from any suitable source, including, but not limited to the genes for *Bacillus subtilis* alkaline protease (aprE), *Bacillus subtilis* neutral protease (nprT), *Saccharomyces cerevisiae* alpha-factor, *Rhizomucor miehei* aspartic proteinase, and *Myceliophthora thermophila* lactase (See e.g., WO 95/33836). Where both signal peptide and propeptide regions are present at the amino terminus of a polypeptide, the propeptide region is positioned next to the amino terminus of a polypeptide and the signal peptide region is positioned next to the amino terminus of the propeptide region.

In some embodiments, regulatory sequences are also utilized. These sequences facilitate the regulation of the expression of the polypeptide relative to the growth of the host cell. Examples of regulatory systems are those that cause the expression of the gene to be turned on or off in response to a chemical or physical stimulus, including the presence of a regulatory compound. In prokaryotic host cells, suitable regulatory sequences include, but are not limited to the lac, tac, and trp operator systems. In yeast host cells, suitable regulatory systems include, but are not limited to the ADH2 system or GAL1 system. In filamentous fungi, suitable regulatory sequences include, but are not limited to the TAKA alpha-amylase promoter, *Aspergillus niger* glucoamylase promoter, and *Aspergillus oryzae* glucoamylase promoter.

In another aspect, the present invention is directed to a recombinant expression vector comprising a polynucleotide encoding an engineered DNA polymerase polypeptide, and one or more expression regulating regions such as a promoter and a terminator, a replication origin, etc., depending on the type of hosts into which they are to be introduced. In some embodiments, the various nucleic acid and control sequences described herein are joined together to produce recombinant expression vectors which include one or more convenient restriction sites to allow for insertion or substitution of the nucleic acid sequence encoding the DNA polymerase polypeptide at such sites. Alternatively, in some embodiments, the nucleic acid sequence of the present invention is expressed by inserting the nucleic acid sequence or a nucleic acid construct comprising the sequence into an appropriate vector for expression. In some embodiments involving the creation of the expression vector, the coding sequence is located in the vector so that the coding sequence is operably linked with the appropriate control sequences for expression.

The recombinant expression vector may be any suitable vector (e.g., a plasmid or virus), that can be conveniently subjected to recombinant DNA procedures and bring about the expression of the DNA polymerase polynucleotide sequence. The choice of the vector typically depends on the compatibility of the vector with the host cell into which the vector is to be introduced. The vectors may be linear or closed circular plasmids.

In some embodiments, the expression vector is an autonomously replicating vector (i.e., a vector that exists as an extra-chromosomal entity, the replication of which is independent of chromosomal replication, such as a plasmid, an extra-chromosomal element, a minichromosome, or an artificial chromosome). The vector may contain any means for assuring self-replication. In some alternative embodiments, the vector is one in which, when introduced into the host cell, it is integrated into the genome and replicated together with the chromosome(s) into which it has been integrated. Furthermore, in some embodiments, a single vector or plasmid, or two or more vectors or plasmids which together contain the total DNA to be introduced into the genome of the host cell, and/or a transposon is utilized.

In some embodiments, the expression vector contains one or more selectable markers, which permit easy selection of transformed cells. A "selectable marker" is a gene, the product of which provides for biocide or viral resistance, resistance to heavy metals, prototrophy to auxotrophs, and the like. Examples of bacterial selectable markers include, but are not limited to the dal genes from *Bacillus subtilis* or *Bacillus licheniformis*, or markers, which confer antibiotic resistance such as ampicillin, kanamycin, chloramphenicol or tetracycline resistance. Suitable markers for yeast cells include, but are not limited to ADE2, HIS3, LEU2, LYS2, MET3, TRP1, and URA3. Selectable markers for use in filamentous fungal host cells include, but are not limited to, amdS (acetamidase; e.g., from *A. nidulans* or *A. orzyae*), argB (ornithine carbamoyltransferases), bar (phosphinothricin acetyltransferase; e.g., from *S. hygroscopicus*), hph (hygromycin phosphotransferase), niaD (nitrate reductase), pyrG (orotidine-5'-phosphate decarboxylase; e.g., from *A. nidulans* or *A. orzyae*), sC (sulfate adenyltransferase), and trpC (anthranilate synthase), as well as equivalents thereof. In another aspect, the present invention provides a host cell comprising at least one polynucleotide encoding at least one engineered DNA polymerase polypeptide of the present invention, the polynucleotide(s) being operatively linked to one or more control sequences for expression of the engineered DNA polymerase enzyme(s) in the host cell. Host cells suitable for use in expressing the polypeptides encoded by the expression vectors of the present invention are well known in the art and include but are not limited to, bacterial cells, such as *E. coli, Vibrio fluvialis, Streptomyces* and *Salmonella typhimurium* cells; fungal cells, such as yeast cells (e.g., *Saccharomyces cerevisiae* or *Pichia pastoris* (ATCC Accession No. 201178)); insect cells such as *Drosophila* S2 and *Spodoptera* Sf9 cells; animal cells such as CHO, COS, BHK, 293, and Bowes melanoma cells; and plant cells. Exemplary host cells also include various *Escherichia coli* strains (e.g., W3110 (ΔfhuA) and BL21).

Accordingly, in another aspect, the present invention provides methods of producing the engineered DNA polymerase polypeptides, where the methods comprise culturing a host cell capable of expressing a polynucleotide encoding the engineered DNA polymerase polypeptide under conditions suitable for expression of the polypeptide. In some embodiments, the methods further comprise the steps of isolating and/or purifying the DNA polymerase polypeptides, as described herein.

Appropriate culture media and growth conditions for host cells are well known in the art. It is contemplated that any suitable method for introducing polynucleotides for expression of the DNA polymerase polypeptides into cells will find use in the present invention. Suitable techniques include, but are not limited to electroporation, biolistic particle bombardment, liposome mediated transfection, calcium chloride transfection, and protoplast fusion.

Engineered DNA polymerase polypeptides with the properties disclosed herein can be obtained by subjecting the polynucleotide encoding the naturally occurring or engineered DNA polymerase polypeptide to any suitable mutagenesis and/or directed evolution methods known in the art, and/or as described herein. An exemplary directed evolution technique is mutagenesis and/or DNA shuffling (See e.g., Stemmer, Proc. Natl. Acad. Sci. USA 91:10747-10751 [1994]; WO 95/22625; WO 97/0078; WO 97/35966; WO 98/27230; WO 00/42651; WO 01/75767 and U.S. Pat. No. 6,537,746). Other directed evolution procedures that can be used include, among others, staggered extension process (StEP), in vitro recombination (See e.g., Zhao et al., Nat. Biotechnol., 16:258-261 [1998]), mutagenic PCR (See e.g., Caldwell et al., PCR Methods Appl., 3:S136-S140 [1994]), and cassette mutagenesis (See e.g., Black et al., Proc. Natl. Acad. Sci. USA 93:3525-3529 [1996]).

Mutagenesis and directed evolution methods can be readily applied to DNA polymerase-encoding polynucleotides to generate variant libraries that can be expressed, screened, and assayed. Any suitable mutagenesis and directed evolution methods find use in the present invention and are well known in the art (See e.g., U.S. Pat. Nos. 5,605,793, 5,811,238, 5,830,721, 5,834,252, 5,837,458, 5,928,905, 6,096,548, 6,117,679, 6,132,970, 6,165,793, 6,180,406, 6,251,674, 6,265,201, 6,277,638, 6,287,861, 6,287,862, 6,291,242, 6,297,053, 6,303,344, 6,309,883, 6,319,713, 6,319,714, 6,323,030, 6,326,204, 6,335,160, 6,335,198, 6,344,356, 6,352,859, 6,355,484, 6,358,740, 6,358,742, 6,365,377, 6,365,408, 6,368,861, 6,372,497, 6,337,186, 6,376,246, 6,379,964, 6,387,702, 6,391,552, 6,391,640, 6,395,547, 6,406,855, 6,406,910, 6,413,745, 6,413,774, 6,420,175, 6,423,542, 6,426,224, 6,436,675, 6,444,468, 6,455,253, 6,479,652, 6,482,647, 6,483,011, 6,484,105, 6,489,146, 6,500,617, 6,500,639, 6,506,602, 6,506,603, 6,518,065, 6,519,065, 6,521,453, 6,528,311, 6,537,746, 6,573,098, 6,576,467, 6,579,678, 6,586,182, 6,602,986, 6,605,430, 6,613,514, 6,653,072, 6,686,515, 6,703,240, 6,716,631, 6,825,001, 6,902,922, 6,917,882, 6,946,296, 6,961,664, 6,995,017, 7,024,312, 7,058,515, 7,105,297, 7,148,054, 7,220,566, 7,288,375, 7,384,387, 7,421,347, 7,430,477, 7,462,469, 7,534,564, 7,620,500, 7,620,502, 7,629,170, 7,702,464, 7,747,391, 7,747,393, 7,751,986, 7,776,598, 7,783,428, 7,795,030, 7,853,410, 7,868,138, 7,783,428, 7,873,477, 7,873,499, 7,904,249, 7,957,912, 7,981,614, 8,014,961, 8,029,988, 8,048,674, 8,058,001, 8,076,138, 8,108,150, 8,170,806, 8,224,580, 8,377,681, 8,383,346, 8,457,903, 8,504,498, 8,589,085, 8,762,066, 8,768,871, 9,593,326, 9,665,694, 9,684,771, and all related PCT and non-US counterparts; Ling et al., Anal. Biochem., 254(2):157-78 [1997]; Dale et al., Meth. Mol. Biol., 57:369-74 [1996]; Smith, Ann. Rev. Genet., 19:423-462 [1985]; Botstein et al., Science, 229:1193-1201 [1985]; Carter, Biochem. J., 237:1-7 [1986]; Kramer et al., Cell, 38:879-887 [1984]; Wells et al., Gene, 34:315-323 [1985]; Minshull et al., Curr. Op. Chem. Biol., 3:284-290 [1999]; Christians et al., Nat. Biotechnol., 17:259-264 [1999]; Crameri et al., Nature, 391:288-291 [1998]; Crameri, et al., Nat. Biotechnol., 15:436-438 [1997]; Zhang et al., Proc. Nat. Acad. Sci. U.S.A., 94:4504-4509 [1997]; Crameri et al., Nat. Biotechnol., 14:315-319 [1996]; Stemmer, Nature, 370:389-391 [1994]; Stemmer, Proc. Nat. Acad. Sci. USA, 91:10747-10751 [1994]; EP 3 049 973; WO 95/22625; WO 97/0078; WO 97/35966; WO 98/27230; WO 00/42651; WO 01/75767; WO 2009/152336; and WO 2015/048573, all of which are incorporated herein by reference).

In some embodiments, the enzyme clones obtained following mutagenesis treatment are screened by subjecting the enzyme preparations to a defined temperature (or other assay conditions) and measuring the amount of enzyme activity remaining after heat treatments or other suitable assay conditions. Clones containing a polynucleotide encoding a DNA polymerase polypeptide are then isolated from the gene, sequenced to identify the nucleotide sequence changes (if any), and used to express the enzyme in a host cell. Measuring enzyme activity from the expression libraries can be performed using any suitable method known in the art (e.g., standard biochemistry techniques, such as HPLC analysis).

For engineered polypeptides of known sequence, the polynucleotides encoding the enzyme can be prepared by standard solid-phase methods, according to known synthetic methods. In some embodiments, fragments of up to about 100 bases can be individually synthesized, then joined (e.g., by enzymatic or chemical ligation methods, or polymerase mediated methods) to form any desired continuous sequence. For example, polynucleotides and oligonucleotides disclosed herein can be prepared by chemical synthesis using the classical phosphoramidite method (See e.g., Beaucage et al., Tet. Lett., 22:1859-69 [1981]; and Matthes et al., EMBO J., 3:801-05 [1984]), as it is typically practiced in automated synthetic methods. According to the phosphoramidite method, oligonucleotides are synthesized (e.g., in an automatic DNA synthesizer, purified, annealed, ligated and cloned in appropriate vectors).

Accordingly, in some embodiments, a method for preparing the engineered DNA polymerase polypeptide can comprise: (a) synthesizing a polynucleotide encoding a polypeptide comprising an amino acid sequence selected from the amino acid sequence of any variant as described herein, and (b) expressing the DNA polymerase polypeptide encoded by the polynucleotide. In some embodiments of the method, the amino acid sequence encoded by the polynucleotide can optionally have one or several (e.g., up to 3, 4, 5, or up to 10) amino acid residue deletions, insertions and/or substitutions. In some embodiments, the amino acid sequence has optionally 1-2, 1-3, 1-4, 1-5, 1-6, 1-7, 1-8, 1-9, 1-10, 1-15, 1-20, 1-21, 1-22, 1-23, 1-24, 1-25, 1-30, 1-35, 1-40, 1-45, or 1-50 amino acid residue deletions, insertions and/or substitutions. In some embodiments, the amino acid sequence has optionally 1, 2, 3, 4, 5, 6, 7, 8, 9, 10, 11, 12, 13, 14, 15, 16, 17, 18, 19, 20, 21, 22, 23, 24, 25, 30, 35, 40, 45, or 50 amino acid residue deletions, insertions and/or substitutions.

In some embodiments, the amino acid sequence has optionally 1, 2, 3, 4, 5, 6, 7, 8, 9, 10, 11, 12, 13, 14, 15, 16, 18, 20, 21, 22, 23, 24, or 25 amino acid residue deletions, insertions and/or substitutions. In some embodiments, the substitutions are conservative or non-conservative substitutions.

The expressed engineered DNA polymerase polypeptide can be evaluated for any desired improved property or combination of properties (e.g., activity, selectivity, fidelity, stability, thermostability, tolerance to various pH levels, protease sensitivity, etc.) using any suitable assay known in the art, including but not limited to the assays and conditions described herein.

In some embodiments, any of the engineered DNA polymerase polypeptides expressed in a host cell are recovered from the cells and/or the culture medium using any one or more of the well-known techniques for protein purification, including, among others, lysozyme treatment, sonication, filtration, salting-out, ultra-centrifugation, and chromatography.

Chromatographic techniques for isolation of the DNA polymerase polypeptides include, among others, reverse phase chromatography, high-performance liquid chromatography, ion-exchange chromatography, hydrophobic-interaction chromatography, size-exclusion chromatography, gel electrophoresis, and affinity chromatography. Conditions for purifying a particular enzyme depends, in part, on factors such as net charge, hydrophobicity, hydrophilicity, molecular weight, molecular shape, etc., and will be apparent to those having skill in the art. In some embodiments, affinity techniques may be used to isolate the improved DNA polymerase enzymes. For affinity chromatography purification, any antibody that specifically binds a DNA polymerase polypeptide of interest may find use. For the production of antibodies, various host animals, including but not limited to rabbits, mice, rats, etc., are immunized by injection with a DNA polymerase polypeptide, or a fragment thereof. In some embodiments, the DNA polymerase polypeptide or fragment is attached to a suitable carrier, such as BSA, by means of a side chain functional group or linkers attached to a side chain functional group.

In some embodiments, the engineered DNA polymerase polypeptide is produced in a host cell by a method comprising culturing a host cell (e.g., an *E. coli* strain) comprising a polynucleotide sequence encoding an engineered DNA polymerase polypeptide as described herein under conditions conducive to the production of the engineered DNA polymerase polypeptide and recovering the engineered DNA polymerase polypeptide from the cells and/or culture medium. In some embodiments, the host cell produces more than one engineered DNA polymerase polypeptide.

In some embodiments, the present invention provides a method of producing an engineered DNA polymerase polypeptide comprising culturing a recombinant bacterial cell comprising a polynucleotide sequence encoding an engineered DNA polymerase polypeptide having at least 85%, 90%, 95%, 96%, 97%, 98%, or 99% sequence identity to reference sequences SEQ ID NO: 2, 6, 26, 24, 26, 28, and/or 824, and one or more amino acid residue differences, under suitable culture conditions to allow the production of the engineered DNA polymerase polypeptide and optionally recovering the engineered DNA polymerase polypeptide from the culture and/or cultured bacterial cells. In some embodiments, the host cell produces more than one engineered DNA polymerase polypeptide.

In some embodiments, once the engineered DNA polymerase polypeptides are recovered from the recombinant host cells and/or culture medium, they are further purified by any suitable method(s) known in the art. In some additional embodiments, the purified engineered DNA polymerase polypeptides are combined with other ingredients and compounds to provide compositions and formulations comprising the engineered DNA polymerase polypeptide as appropriate for different applications and uses (e.g., diagnostic methods and compositions).

EXPERIMENTAL

The following Examples, including experiments and results achieved, are provided for illustrative purposes only and are not to be construed as limiting the present invention.

In the experimental disclosure below, the following abbreviations apply: ppm (parts per million); M (molar); mM (millimolar), uM and µM (micromolar); nM (nanomolar); mol (moles); gm and g (gram); mg (milligrams); ug and µg (micrograms); L and l (liter); ml and mL (milliliter); cm (centimeters); mm (millimeters); um and µm (micrometers); sec. (seconds); min(s) (minute(s)); h(s) and hr(s) (hour(s)); Ω (ohm); gf (microfarad); U (units); MW (molecular weight); rpm (rotations per minute); rcf (relative centrifugal force); psi and PSI (pounds per square inch); ° C. (degrees Centigrade); RT and rt (room temperature); NGS (next-generation sequencing); ds (double stranded); ss (single stranded); CDS (coding sequence); DNA (deoxyribonucleic acid); RNA (ribonucleic acid); E. coli W3110 (commonly used laboratory E. coli strain, available from the Coli Genetic Stock Center [CGSC], New Haven, Conn.); HTP (high throughput); HPLC (high pressure liquid chromatography); MCYP (microcyp); ddH2O (double distilled water); PBS (phosphate buffered saline); BSA (bovine serum albumin); DTT (dithiothreitol); CAM (chloramphenicol); CAT (chloramphenicol acetyltransferase); IPTG (isopropyl β-D-1-thiogalactopyranoside); GFP (green fluorescent protein); eGFP (enhanced GFP); DsRed (red fluorescent protein isolated from Discosoma sp.); FIOPC (fold improvements over positive control); LB (Luria-Bertani); SPRI (solid phase reversible immobilization); Sigma-Aldrich (Sigma-Aldrich, St. Louis, Mo.); Perkin Elmer (Perkin Elmer, Inc, Waltham, Mass.); Harvard Apparatus (Harvard Apparatus, Holliston, Mass.); Millipore (Millipore, Corp., Billerica Mass.); Covaris (Covaris, Inc., Woburn, Mass.); MagBio (MagBio Genomics, Inc., Gaithersburg, Md.); Qiagen (Qiagen Inc., Germantown, Md.); Illumina (Illumina, Inc., San Diego, Calif.); BD Biosciences (BD Biosciences, San Jose, Calif.); Difco (Difco Laboratories, BD Diagnostic Systems, Detroit, Mich.); Kuhner (Adolf Kuhner, AG, Basel, Switzerland); Zymo (Zymo Research, Irvine, Calif.); Agilent (Agilent Technologies, Inc., Santa Clara, Calif.); Thermo Scientific (part of Thermo Fisher Scientific, Waltham, Mass.); GE Healthcare (GE Healthcare Bio-Sciences, Piscataway, N.J.); and Bio-Rad (Bio-Rad Laboratories, Hercules, Calif.).

Example 1

DNA Polymerase Gene Acquisition and Construction of Expression Vectors

A Group B polymerase encoded by the genome of *Thermococcus* sp. strain 2319x1 (Unprot ID A0A0U3SCT0; SEQ ID NOS: 1 and 2, polynucleotide and polypeptide sequences, respectively), shares 73% protein sequence identity with *Pyrococcus furiosus* DNA polymerase (SEQ ID NO: 4). This polymerase (SEQ ID NO: 2) is referred to herein as "Pol3." For clarity, this enzyme is not the same as the DNA polymerase III holoenzyme involved in prokaryotic DNA replication. A synthetic gene (SEQ ID NO: 5) encoding a 6-histidine tagged version of the wild-type (WT) Pol3 polymerase (SEQ ID NO: 6), was constructed and subcloned into the *Escherichia coli* expression vector pCK100900i (See e.g., U.S. Pat. No. 7,629,157 and US Pat. Appln. Publn. No. 2016/0244787, both of which are hereby incorporated by reference). These plasmid constructs were transformed into an *E. coli* strain derived from W3110. Directed evolution techniques generally known by those skilled in the art were used to generate libraries of gene variants from these plasmids (See e.g., U.S. Pat. No. 8,383, 346 and WO 2010/144103, both of which are hereby incorporated by reference). The substitutions in the enzyme variants described herein are indicated with reference to the 6-histidine tagged enzyme (i.e., SEQ ID NO: 6) or variants thereof, as indicated.

Example 2

High-Throughput (HTP) Pol3 DNA Polymerase Expression and Lysate Preparation

In this Example, methods used for HTP growth and lysate preparation of polymerase variants are described.

High-Throughput Growth of Pol3 Polymerase and Variants

Transformed *E. coli* cells were selected by plating onto LB agar plates containing 1% glucose and 30 µg/ml chloramphenicol. After overnight incubation at 37° C., colonies were placed into the wells of 96-well shallow flat bottom NUNC™ microplates (Thermo-Scientific) filled with 180 µl/well LB medium supplemented with 1% glucose and 30 µg/ml chloramphenicol. The cultures were allowed to grow overnight for 18-20 hours in a shaker (200 rpm, 30° C., and 85% relative humidity; Kuhner). Overnight growth samples (20 µL) were transferred into Costar 96-well deep plates filled with 380 µL of Terrific Broth supplemented with 30 µg/ml chloramphenicol. The plates were incubated for 120 minutes in a shaker (250 rpm, 30° C., and 85% relative humidity; Kuhner) until the $OD_{600}$ reached between 0.4-0.8. The cells were then induced with 40 µL of 10 mM IPTG in sterile water and incubated overnight for 18-20 hours in a shaker (250 rpm, 30° C., and 85% relative humidity; Kuhner). The cells were pelleted (4000 rpm×20 min), the supernatants were discarded, and the cells were frozen at −80° C. prior to analysis.

Lysis of HTP Pellets

Cell pellets were thawed and resuspended by shaking for 10 minutes at room temperature in 300 µl/well of lysis buffer (20 mM NaCl, 50 mM Tris-HCl, pH 7.5). Then, 150 ul of the resuspended pellet was transferred into a HARDSHELL® PCR plate (Bio-Rad). Cell lysis and heat treatment were achieved in a single thermocycler incubation step at 93° C. for 60 minutes. Cell debris and heat-insoluble material were pelleted (4000 rpm×10 min), and the clarified lysate supernatants were used for PCR assays as described in the following Examples.

Example 3

PCR Product Yield Assays

Selection of Pol3 variants was achieved by measuring PCR product yield in an end-point PCR assay with short extension times relative to length of the template used. Each variant was screened in a 30 µL reaction comprised of 80 pg/µL MCYP template DNA (SEQ ID NO: 7), 0.2 mM dNTPs, 400 nM each of the MCYP forward (SEQ ID NO:

10) and reverse (SEQ ID NO: 11) primers, 20 mM Tris buffer, pH 8.8, 10 mM KCl, 2 mM MgSO$_4$, 10 mM (NH$_4$)$_2$SO$_4$, 0.1% v/v Triton x-100, and 0.1 g/L BSA. Lysates were diluted in 20 mM Tris, pH 8.8, and 5 ul of the diluted lysates were added to a PCR master mix to a final concentration of 0.12-0.58% (v/v) lysates, as indicated in the conditions below each table in the following Examples. PCR cycling included an initial denaturation for 2 min at 95° C. followed by 25 cycles of: 95° C. for 25 sec, annealing at 51°-53° C. for 30 sec, and extension at 72° C. for 10 sec to 2.25 min. Lysate concentrations, annealing temperatures and extension times are included for each table in the example. At the completion of the reaction, 70 μL of ddH$_2$O was added to each reaction. The 3 kb MCYP PCR products were quantified using the DNA 5k assay on a LABCHIP® GX capillary electrophoresis instrument (Perkin-Elmer). For Table 3.2, the product yield was qualitatively ranked after electrophoresis on E-gel 96 1% agarose gels (ThermoFisher).

TABLE 3.1

Product Yield Improvements Relative to SEQ ID NO: 6

| SEQ ID NO: (nt/aa) | Amino Acid Differences (Relative to SEQ ID NO: 6) | Product Yield Improvement (Relative to SEQ ID NO: 6)[1] |
|---|---|---|
| 29/30 | K391E/L671P | +++ |
| 31/32 | L283M/D647H/T702A/P743A | +++ |
| 33/34 | D647H/D659E/V661T/I664L/R668E/T702A | +++ |
| 35/36 | D647H/D659E/R668E/L671P/L716I/V728A | +++ |
| 37/38 | K391E/D647H/L671P/V728A | +++ |
| 39/40 | L671P/T702A | ++ |
| 41/42 | K391E | +++ |
| 43/44 | R668E/T702A | ++ |
| 45/46 | D659E/T702A/P743A | ++ |
| 47/48 | K391E/D659E/T702A/L716I/T732E/E737R | ++ |
| 49/50 | K391E/D647H/D659E/V661T/R668E/L671P/I712V/L716I | ++ |
| 51/52 | D647H/R668E | ++ |
| 53/54 | K391E/T702A/I712V/L716I/T732E/P743A | ++ |
| 55/56 | D647H/D659E/I664L/R668E/T702A/I712V/E737R | ++ |
| 57/58 | L671P/T702A/L716I | ++ |
| 59/60 | K391E/D647H/D659E/V661T/R668E/L671P/L716I | + |
| 61/62 | D647H/R668E/L671P/I712V | + |
| 63/64 | K391E/D647H/D659E/I664L/R668E/T702A/V728A/T732E | + |
| 65/66 | P743A | + |
| 67/68 | K391E/D647H/V661T/I664L/L671P/T702A/L716I | + |
| 69/70 | N282K/R575L | + |
| 71/72 | K391E/D647H/D659E/I664L/L671P/T702A | + |
| 73/74 | K391E/V661T/I664L/R668E/L671P/L716I/E737R | + |
| 75/76 | K21E/K66T/K247G/N282R | + |
| 77/78 | R372S/K391E/T702A | + |
| 79/80 | T702A | + |
| 81/82 | F339L/D647H/V661T/I664L/R668E/T702A/I712V | + |
| 83/84 | K247G/N282K/R575L | + |
| 85/86 | K21E | + |
| 87/88 | V661T/I664L/R668E/L671P/L716I | + |

[1]Levels of increased activity were determined relative to the reference polypeptide of SEQ ID NO: 6, and were defined as follows:
"+" = 1.20 to 1.29 (first 50%);
"++" > 1.29 (next 30%); and
"+++" > 1.36 (top 20%).
In these reaction, the lysate % volume (v/v) was 0.45, the annealing temperature was 53° C., and the extension time was 1.5 minutes.

TABLE 3.2

Product Yield Improvements Relative to SEQ ID NO: 6

| SEQ ID NO: (nt/aa) | Amino Acid Differences (Relative to SEQ ID NO: 6) | Product Yield Improvement (Relative to SEQ ID NO: 6)[1] |
|---|---|---|
| 89/90 | K478L | ++ |
| 91/92 | N282R | ++ |
| 93/94 | R420A | +++ |
| 95/96 | M257W | +++ |
| 97/98 | P514R | +++ |
| 99/100 | T619C | +++ |
| 101/102 | V603R | +++ |
| 103/104 | K391A | +++ |
| 105/106 | R668C | +++ |
| 107/108 | L394G | ++ |
| 109/110 | K391G | +++ |
| 111/112 | E760G | +++ |
| 113/114 | A761W | +++ |
| 115/116 | K738V | +++ |
| 117/118 | A376V/T619F | +++ |
| 119/120 | P101S/K646R | +++ |
| 121/122 | Y48H/E760H | +++ |
| 123/124 | R420I | ++ |
| 125/126 | R420G | ++ |
| 127/128 | G691S | ++ |
| 129/130 | K515F | ++ |
| 131/132 | T528S | ++ |
| 133/134 | T619V | ++ |
| 135/136 | A761R | ++ |
| 137/138 | R108C/Q679S | ++ |
| 139/140 | Y18H/E387C | ++ |
| 141/142 | S360R | + |
| 143/144 | Y390G | ++ |
| 145/146 | M257R | ++ |
| 147/148 | S421Q | + |
| 149/150 | R420V | + |
| 151/152 | R420K | ++ |
| 153/154 | S361G | + |
| 155/156 | S361W | + |
| 157/158 | K515R | + |
| 159/160 | K521T | ++ |
| 161/162 | K515G | + |
| 163/164 | T528A | ++ |
| 165/166 | K666T | ++ |
| 167/168 | E662C | ++ |
| 169/170 | A754C | + |
| 171/172 | E631G | + |
| 173/174 | K685D | + |
| 175/176 | S721R | + |
| 177/178 | P43L/T528S | + |
| 179/180 | L394M/L399R | + |
| 181/182 | K24M/K719A | + |
| 183/184 | S583N/L730A | ++ |
| 185/186 | S506R | + |
| 187/188 | R359C | + |
| 189/190 | L502A | + |
| 191/192 | S421M | + |
| 193/194 | Y390Q | + |
| 195/196 | Y390A | + |
| 197/198 | S360V | + |
| 199/200 | S360T | + |
| 201/202 | S361M | + |
| 203/204 | T362R | + |
| 205/206 | K521P | + |
| 207/208 | L394T | + |
| 209/210 | D223N | + |
| 211/212 | L394N | + |
| 213/214 | R668L | + |
| 215/216 | E655W | + |
| 217/218 | K646R | + |
| 219/220 | T702A | + |

TABLE 3.2-continued

Product Yield Improvements Relative to SEQ ID NO: 6

| SEQ ID NO: (nt/aa) | Amino Acid Differences (Relative to SEQ ID NO: 6) | Product Yield Improvement (Relative to SEQ ID NO: 6)[1] |
|---|---|---|
| 221/222 | S721T | + |
| 223/224 | E760F | + |

[1]Levels of increased activity were determined relative to the reference polypeptide of SEQ ID NO: 6, and were defined as follows:
"+" = 1.00 to 2.00 (first 50%);
"++" > 2.00 (next 30%); and
"+++" > 4.00 (top 20%).
In these reaction, the lysate % volume (v/v) was 0.45, the annealing temperature was 53° C., and the extension time was 1.5 minutes.

TABLE 3.3

Product Yield Improvements Relative to SEQ ID NO: 22

| SEQ ID NO: (nt/aa) | Amino Acid Differences (Relative to SEQ ID NO: 22) | Product Yield Improvement (Relative to SEQ ID NO: 22)[1] |
|---|---|---|
| 225/226 | L502I/Y507F/S695A | +++ |
| 227/228 | S361G/L394T/R420A/T528S/K646R/K666T/S721T/A743P | +++ |
| 229/230 | T528S/K646R/E659D/R668L/A743P | +++ |
| 231/232 | S361G/T528A/K646R/K666T | ++ |
| 233/234 | L394G/R420K | ++ |
| 235/236 | S361G/L394T/R420A/T528A/K666T | ++ |
| 237/238 | T528S/R668L | ++ |
| 239/240 | K685D/G691S/A743P | ++ |
| 241/242 | K666T | ++ |
| 243/244 | S361G/T528S/K646R/A702T/S721T | + |
| 245/246 | T528S/A743P | + |
| 247/248 | S361W/L394T/R420A/K646R/K666T/A702T/S721T/A743P | + |
| 249/250 | S361G/T528A/K666T | + |
| 251/252 | S361M/K391E/E659D | + |
| 253/254 | T619C | + |
| 255/256 | S361G/K646R | + |
| 257/258 | A174V/S361G/L394T/K666T/R668L/S721T | + |
| 259/260 | S360T/K391G | + |
| 261/262 | T528S/K666T | + |

[1]Levels of increased activity were determined relative to the reference polypeide of SEQ ID NO: 22 and were defined as follows:
"+" = 1.25 to 1.33 (first 50%);
"++" > 1.33 (next 30%); and
"+++" > 1.43 (top 20%).
In these reaction, the lysate % volume (v/v) was 0.2, the annealing temperature was 51° C., and the extension time was 0.167 minutes.
In this TABLE, "*" indicates the presence of a premature termination codon; the last 7 amino acids of the protein are not present.
Also in this TABLE, "—" indicates the deletion of the amino acid at position 786 in the protein.

TABLE 3.4

Product Yield Improvements Relative to SEQ ID NO: 22

| SEQ ID NO: (nt/aa) | Amino Acid Differences (Relative to SEQ ID NO: 22) | Product Yield Improvement (Relative to SEQ ID NO: 22)[1] |
|---|---|---|
| 263/264 | R496A | +++ |
| 265/266 | Q497D | +++ |
| 267/268 | G468N | +++ |
| 269/270 | V277A | +++ |
| 271/272 | K482V | ++ |
| 273/274 | K490L | ++ |
| 275/276 | K480M | ++ |
| 277/278 | H100Y | ++ |
| 279/280 | K491L | ++ |
| 281/282 | K482Q | ++ |
| 283/284 | K479Q | + |
| 285/286 | K479P | + |
| 287/288 | E489V | + |
| 289/290 | G401S | + |
| 291/292 | I281C | + |
| 293/294 | T280Y | + |
| 295/296 | R498C | + |
| 297/298 | L283V | + |
| 299/300 | K480D | + |
| 301/302 | F339M | + |

[1]Levels of increased activity were determined relative to the reference polypepide of SEQ ID NO: 22 and were defined as follows:
"+" = 1.25 to 1.33 (first 50%);
"++" > 1.33 (next 30%); and
"+++" > 1.42 (top 20%).
In these reaction, the lysate % volume (v/v) was 0.2, the annealing temperature was 51° C., and the extension time was 0.167 minutes.

TABLE 3.5

Product Yield Improvements Relative to SEQ ID NO: 24

| SEQ ID NO: (nt/aa) | Amino Acid Differences (Relative to SEQ ID NO: 24) | Product Yield Improvement (Relative to SEQ ID NO: 24)[1] |
|---|---|---|
| 303/304 | M257W/L671P/D685K/A702T | +++ |
| 305/306 | M257W/D647H | +++ |
| 307/308 | E659D/S691G | +++ |
| 309/310 | Q497D/L671P/L716I | +++ |
| 311/312 | K482Q/Q497D/L671P/D685K | +++ |
| 313/314 | K478L/K479P/R668E | +++ |
| 315/316 | D15N/D134N/K482Q/K490L/Q497D/L671P/D685K | +++ |
| 317/318 | K391E/K478L/K479P/R668E | +++ |
| 319/320 | K391E/I488R/M492V/R668E | +++ |
| 321/322 | K478L/I488R/R668E/D685K/A702T | +++ |
| 323/324 | Q497D/L671P/A702T | +++ |
| 325/326 | I281C/R668E | +++ |
| 327/328 | K391E/K478L | +++ |
| 329/330 | K391G/K479P/E659D/R668E | +++ |
| 331/332 | K482Q/Q497D/D647H/L716I | +++ |
| 333/334 | Q497D/V661T/L671P | +++ |
| 335/336 | K478L | +++ |
| 337/338 | Q497D/D647H/E659D/L671P | +++ |
| 339/340 | K391G/K478L/M492V/R668E | +++ |
| 341/342 | K391G/I488R/Y495N/R668E/D685K/A702T | +++ |
| 343/344 | K478L/K479P/R668E | +++ |
| 345/346 | I281C/K391G/Y495N/T561A/E659D/R668E | +++ |
| 347/348 | I488R/Y495N/D685K | ++ |
| 349/350 | Q497D/D685K | ++ |
| 351/352 | Y390Q/Q497D | ++ |
| 353/354 | R420Q/V661T/L671P | ++ |
| 355/356 | K478L | ++ |
| 357/358 | R420Q/K490L/E659D/V661T/L671P | ++ |
| 359/360 | I281C/K478L/R668E | ++ |
| 361/362 | Q497D/D685K | ++ |
| 363/364 | K490L/Q497D/V661T/L671P/D685K/A702T/L716I | ++ |
| 365/366 | I281C/K391E/K478L/D685K | ++ |
| 367/368 | R420G | ++ |
| 369/370 | I281C/K391G/R668E | ++ |
| 371/372 | A234V/Q497D/D647H | ++ |
| 373/374 | I281C/I488R/Y495N/R668E | ++ |
| 375/376 | M492V | ++ |
| 377/378 | Y390Q/R420Q | ++ |
| 379/380 | M257W/Y390H/R420Q | ++ |

TABLE 3.5-continued

Product Yield Improvements Relative to SEQ ID NO: 24

| SEQ ID NO: (nt/aa) | Amino Acid Differences (Relative to SEQ ID NO: 24) | Product Yield Improvement (Relative to SEQ ID NO: 24)[1] |
|---|---|---|
| 381/382 | Q497D/D647H | ++ |
| 383/384 | K479P/E659D/E678G | ++ |
| 385/386 | R420Q | ++ |
| 387/388 | I488R/M492V | ++ |
| 389/390 | Y390Q/K491D/L671P | ++ |
| 391/392 | Q497D/D647H | ++ |
| 393/394 | L671P | ++ |
| 395/396 | R420Q/K482Q/E659D/A702T | ++ |
| 397/398 | Y390Q/R420Q | ++ |
| 399/400 | K391E/M492V/Y495N/E659D | ++ |
| 401/402 | G401S/K490L | ++ |
| 403/404 | K478L/I488R/E659D | ++ |
| 405/406 | K391E | ++ |
| 407/408 | M257W/Y390Q/R420Q/D647H | ++ |
| 409/410 | I281C/K391E/I488R/M492V | ++ |
| 411/412 | R420Q/K490L | + |
| 413/414 | I281C/I488R/M492V/Y495N/E659D/R668E | + |
| 415/416 | M492V/R668E/I712V | + |
| 417/418 | I281C/I488R/M492V/R668E/A702T | + |
| 419/420 | K391E | + |
| 421/422 | G401S/L671P | + |
| 423/424 | K478L/K515L | + |
| 425/426 | G401S/K482Q/E659D/L671P/A702T | + |
| 427/428 | R420Q/D685K | + |
| 429/430 | R420G | + |
| 431/432 | Y390Q/G401S/L716I | + |
| 433/434 | I281C | + |
| 435/436 | I281C/K391G/K478L | + |
| 437/438 | K391G/Y495N/E659D | + |
| 439/440 | K478L/K479P | + |
| 441/442 | Q497D/A702T | + |
| 443/444 | K391E/I488R/M492V/E659D/D685K | + |
| 445/446 | I488R/Y495N | + |
| 447/448 | Q497D/E659D/S691G/L716I | + |
| 449/450 | M492V/E659D/D685K | + |
| 451/452 | I281C/R668E | + |
| 453/454 | I281C | + |
| 455/456 | I281C/K391G/E659D/R668E | + |
| 457/458 | Y495N | + |
| 459/460 | L671P | + |
| 461/462 | Y495N/E659D/D685K | + |
| 463/464 | M257W/G401S/R420Q/K482Q/D647H/L671P/D685K | + |
| 465/466 | I281C/K391G/K478L | + |
| 467/468 | K482Q/L671P/A702T/L716I | + |
| 469/470 | Q497D/V661T | + |
| 471/472 | I281C/M492V/Y495N/R668E/A702T | + |
| 473/474 | K391G/M492V/Y495N | + |
| 475/476 | M492V/Y495N/E659D/R668E | + |
| 477/478 | K479P/M492V | + |
| 479/480 | K478L/K479P/A702T | + |
| 481/482 | K515L | + |
| 483/484 | I281C/I488R | + |
| 485/486 | M257W/K482Q/Q497D/D647H | + |
| 487/488 | I488R | + |
| 489/490 | K391G/M492V/K515L/E659D/D685K | + |
| 491/492 | I281C | + |
| 493/494 | Y390Q/L671P/D685K | + |
| 495/496 | I281C/K478L/E659D/D685K/A702T | + |
| 497/498 | R420Q/E659D/A702T | + |
| 499/500 | G401S/K490L/E659D/L671P | + |
| 501/502 | I281C/I488R/Y495N | + |
| 503/504 | I281C | + |
| 505/506 | I488R/M492V/Y495N | + |
| 507/508 | M492V/R668E/D685K/I712V | + |
| 509/510 | Y495N/E659D | + |
| 511/512 | I281C/M492V/Y495N/R668E | + |
| 513/514 | G401S | + |
| 515/516 | E659D | + |
| 517/518 | M257W/G401S/R420Q | + |

[1]Levels of increased activity were determined relative to the reference polypeptide of SEQ ID NO: 24 and were defined as follows:
"+" = 1.53 to 2.16 (first 50%);
"++" > 2.16 (next 30%); and
"+++" > 2.68 (top 20%).

In these reaction, the lysate % volume (v/v) was 0.25, the annealing temperature was 53° C., and the extension time was 0.75 minutes.

TABLE 3.6

Product Yield Improvements Relative to SEQ ID NO: 24

| SEQ ID NO: (nt/aa) | Amino Acid Differences (Relative to SEQ ID NO: 24) | Product Yield Improvement (Relative to SEQ ID NO: 24)[1] |
|---|---|---|
| 519/520 | K634R | +++ |
| 521/522 | R785G | +++ |
| 523/524 | A609C/G648Q | +++ |
| 525/526 | G778Q | +++ |
| 527/528 | N579S | +++ |
| 529/530 | G600A | +++ |
| 531/532 | N579M | +++ |
| 533/534 | G648R | +++ |
| 535/536 | N579Q | +++ |
| 537/538 | E536Q | +++ |
| 539/540 | Q772G | +++ |
| 541/542 | E536N | +++ |
| 543/544 | T777D | +++ |
| 545/546 | V624S | +++ |
| 547/548 | R575F | +++ |
| 549/550 | K540G | +++ |
| 551/552 | E536T | +++ |
| 553/554 | N579R | +++ |
| 555/556 | L779D | +++ |
| 557/558 | K566G | +++ |
| 559/560 | I539V | +++ |
| 561/562 | K236R/V755T | +++ |
| 563/564 | V550S/R575Q | ++ |
| 565/566 | R240Y | ++ |
| 567/568 | I656Y | ++ |
| 569/570 | R240A | ++ |
| 571/572 | I415V | ++ |
| 573/574 | I758V | ++ |
| 575/576 | R108A | ++ |
| 577/578 | R108V/K521R | ++ |
| 579/580 | D55E/N579V | ++ |
| 581/582 | N579Q/E767Q | ++ |
| 583/584 | E544G | ++ |
| 585/586 | D780A | ++ |
| 587/588 | E767G | ++ |
| 589/590 | E672G | ++ |
| 591/592 | E568G | ++ |
| 593/594 | D356N | ++ |
| 595/596 | L370D | ++ |
| 597/598 | T299A/K319G | ++ |
| 599/600 | E568L | ++ |
| 601/602 | F601I | ++ |
| 603/604 | I447A | ++ |
| 605/606 | F601M | ++ |
| 607/608 | E389Q | ++ |
| 609/610 | R108G | ++ |
| 611/612 | D356P | ++ |
| 613/614 | I447L | ++ |
| 615/616 | S520C | ++ |
| 617/618 | V624C | ++ |
| 619/620 | R108F | ++ |
| 621/622 | I539S | ++ |

TABLE 3.6-continued

Product Yield Improvements Relative to SEQ ID NO: 24

| SEQ ID NO: (nt/aa) | Amino Acid Differences (Relative to SEQ ID NO: 24) | Product Yield Improvement (Relative to SEQ ID NO: 24)[1] |
|---|---|---|
| 623/624 | F601L/A638L | ++ |
| 625/626 | D780W | ++ |
| 627/628 | T299R | ++ |
| 629/630 | D386P | ++ |
| 631/632 | K319E | + |
| 633/634 | I450Y | + |
| 635/636 | E767T | + |
| 637/638 | K384R | + |
| 639/640 | E248P | + |
| 641/642 | E440H | + |
| 643/644 | D356V | + |
| 645/646 | L370T | + |
| 647/648 | E407L | + |
| 649/650 | E407R | + |
| 651/652 | T299E | + |
| 653/654 | K302F | + |
| 655/656 | R108Y | + |
| 657/658 | K247S | + |
| 659/660 | T299A | + |
| 661/662 | S358I | + |
| 663/664 | L779* | + |
| 665/666 | D55G/N579A | + |
| 667/668 | A309V | + |
| 669/670 | P385L | + |
| 671/672 | N579A | + |
| 673/674 | R575T | + |
| 675/676 | R108C | + |
| 677/678 | R108S | + |
| 679/680 | K319S | + |
| 681/682 | R256A | + |
| 683/684 | W782V | + |
| 685/686 | E407A | + |
| 687/688 | I450L | + |
| 689/690 | I539G | + |
| 691/692 | I539Q | + |
| 693/694 | L370S | + |
| 695/696 | E443V | + |
| 697/698 | I350V | + |
| 699/700 | D386V | + |
| 701/702 | I656A | + |
| 703/704 | F601V | + |
| 705/706 | K247I | + |
| 707/708 | E316G | + |
| 709/710 | K784— | + |
| 711/712 | I539H | + |
| 713/714 | E389R | + |
| 715/716 | V451G | + |
| 717/718 | K298E | + |
| 719/720 | V357S | + |
| 721/722 | P406V | + |
| 723/724 | T299Q | + |
| 725/726 | G648Q | + |
| 727/728 | D386G | + |
| 729/730 | E407S | + |
| 731/732 | E407Y | + |
| 733/734 | W782S | + |
| 735/736 | W411H | + |
| 737/738 | K319H | + |
| 739/740 | R765D | + |
| 741/742 | F156L/V451C | + |
| 743/744 | K566Q | + |

[1]Levels of increased activity were determined relative to the reference polypeptide of SEQ ID NO: 24, and were defined as follows:
"+" = 1.27 to 1.59 (first 50%);
"++" > 1.59 (next 30%); and
"+++" > 2.78 (top 20%).
In these reaction, the lysate % volume (v/v) was 0.3, the annealing temperature was 53° C., and the extension time was 0.75 minutes.
In this TABLE, "*" indicates the presence of a premature termination codon; the last 7 amino acids of the protein are not present.
Also in this TABLE, "—" indicates the deletion of the amino acid at position 784 in the protein.

TABLE 3.7

Product Yield Improvements Relative to SEQ ID NO: 26

| SEQ ID NO: (nt/aa) | Amino Acid Differences (Relative to SEQ ID NO: 26) | Product Yield Improvement (Relative to SEQ ID NO: 26)[1] |
|---|---|---|
| 745/746 | V661T | +++ |
| 747/748 | C281I | +++ |
| 749/750 | C281I/K302F | ++ |
| 751/752 | F339A/K491D/M492V/N579A/I712V | ++ |
| 753/754 | Y390Q/I466A/I539S/I712V | + |
| 755/756 | C281I/M492S | + |
| 757/758 | E248P | + |
| 759/760 | K302F/G401S | + |

[1]Levels of increased activity were determined relative to the reference polypeptide of SEQ ID NO: 26, and were defined as follows:
"+" = 1.43 to 2.58 (first 50%);
"++" > 2.58 (next 30%); and
"+++" > 4.73 (top 20%).
In these reaction, the lysate % volume (v/v) was 0.5, the annealing temperature was 53° C., and the extension time was 2.25 minutes.

TABLE 3.8

Product Yield Improvements Relative to SEQ ID NO: 28

| SEQ ID NO: (nt/aa) | Amino Acid Differences (Relative to SEQ ID NO: 28) | Product Yield Improvement (Relative to SEQ ID NO: 28)[1] |
|---|---|---|
| 761/762 | R420G/K515F | +++ |
| 763/764 | K391G | +++ |
| 765/766 | E659D/T702A | +++ |
| 767/768 | F339A/Y390Q/R420G/S425R/I466A/K490L/K491P/K515L/T702A | ++ |
| 769/770 | K391G/K482Q | ++ |
| 771/772 | E248P/K391G/E659D | ++ |
| 773/774 | K302F/K391G/N579A | ++ |
| 775/776 | K391G/E659D | + |
| 777/778 | R240A/N579A/T702A | + |
| 779/780 | N579A/E659D/T702A | + |
| 781/782 | E248P/K391G/I539S/N579A/E659D/T702A | + |
| 783/784 | R240A/N579A | + |
| 785/786 | N579A | + |
| 787/788 | N579A/T702A | + |

[1]Levels of increased activity were determined relative to the reference polypeptide of SEQ ID NO: 28 and were defined as follows:
"+" = 1.19 to 1.49 (first 50%);
"++" > 1.49 (next 30%); and
"+++" > 1.63 (top 20%).
In these reaction, the lysate % volume (v/v) was 0.3, the annealing temperature was 53° C., and the extension time was 1 minute.

Example 4

High-Throughput Polymerase Fidelity Testing

Colony-based reporter assays are well established as methods to determine polymerase fidelity. In these assays, reporter genes such as lacZ (See, Barnes, Gene 112:29-35 [1992]), lacI (Jozwiakowksi and Connolly, Nucl. Acids Res., 37: e102 [2009]), and rpsL (Kitabayashi et al., Biosci. Biotechnol. Biochem., 66: 2194-2200 [2002]) are replicated, the frequency of gene-inactivating mutations observed in clones is proportional the error rate of the DNA polymerase used in replication of the reporter gene. Error rates are reported as the fraction of colonies with a blue or white phenotype on X-gal (5-Bromo-4-Chloro-3-Indolyl B-D-Galactopyranoside) plates for lacI or lacZ, or by the ratio of colonies that grow on selective ampicillin or streptomycin agar plates for rpsL. Because proofreading DNA polymerase error rates are exceptionally low (e.g., ~3×10$^{-3}$), these techniques require assaying a large number of colonies, in order to reduce the effect of sampling error on the observed error rates. While simple and affordable, compared to direct Sanger sequencing of individual cloned amplicons, these assays have limited throughput.

A high-throughput assay for DNA polymerase fidelity was developed for use in the present invention, using a cell-based flow cytometry assay. A reporter plasmid (SEQ ID NO: 18) was constructed which encodes genes for two fluorescent proteins, eGFP (SEQ ID NO: 14) and wild-type dsRed (SEQ ID NO: 16), under the control of an inducible LacI promoter. The plasmid also encodes a gene for chloramphenicol acetyltransferase to for selection. When this reporter plasmid is transformed into *E. coli* and induced with IPTG, both fluorescent proteins are expressed in the majority of the cells in the population. An *E. coli* population expressing a single fluorescent protein (e.g., dsRed) exhibits a broad log-normal distribution of fluorescence intensities due to the variations in induction and noise in gene expression. Thus, mutations that inactivate the dsRed would be indistinguishable from noise in gene expression. While there is a wide range of gene expression among cells in the double-labeled (eGFP/dsRed) population, the two proteins co-vary in their expression. As a result, cells that strongly express eGFP without expressing dsRed are extremely rare, and cells expressing reporter plasmids that have inactivating mutations in dsRed (but retain eGFP expression) are easily distinguished from background.

A PCR reaction is performed with a variant polymerase and abutting 5′-phosphorylated primers to replicate the entire sequence of the reporter plasmid. During PCR amplification, polymerase-induced errors are introduced into one or both of the fluorescent reporter proteins encoded by the reporter plasmid. The replication products are circularized via ligation, transformed into *E. coli*, and the mixed population of wild-type and error-containing transformants is induced to express the dual reporters. The induced population of cells is then analyzed using flow cytometry to determine the fraction of cells that have lost dsRed expression due to PCR errors but still express GFP. Importantly, when an isolated clone of the WT reporter plasmid is induced for 48-72 hours and analyzed via flow cytometry, the background of cells expressing only eGFP is extremely low.

The reporter construct was amplified using 5′-phosphorylated forward (SEQ ID NO: 19) and reverse (SEQ ID NO: 20) primers as described for the PCR reactions in Example 2. Typically, a final concentration of 0.25% volume/volume HTP lysate was used for each DNA polymerase. Reactions of 50 ul were assembled with the fidelity reporter construct (SEQ ID NO: 18) at a final concentration of 120 pg/ul. An extension time of 5 minutes was used during cycling. In order to remove background DNA that had not been amplified by the DNA polymerase variant via PCR, the remaining methylated full-length reporter plasmid PCR template (SEQ ID NO: 18) was fragmented by the addition of DpnI restriction enzyme followed by incubation at 37° C. for 15 minutes.

Linear ssDNA PCR amplicons were purified by column purification using ZR-96 DNA Clean and Concentrator (Zymo). Briefly, 200 µl of the supplied binding buffer was added to the 50 µl PCR reactions, and samples were processed per the manufacturer's protocol. Samples were eluted in 10-50 µl of nuclease-free water.

The purified linear amplicons were then circularized in a 200 µl ligation reaction with final component concentrations of 66 mM Tris-HCl, pH 8.0, 1 mM ATP, 10 mM MgCl$_2$, 1 mM DTT, 50 ng/µl DNA ligase (SEQ ID NO: 38 of U.S. patent application Ser. No. 15/972,919) for 1 hour at 20° C.

Circularized amplicons were then purified and concentrated using the ZR-96 DNA Clean and Concentrator (Zymo). Briefly, 600 µl of the supplied Binding Buffer was added to the 200 µl ligation reactions, and samples were processed using the manufacturer's protocol. Samples were eluted in 12 µl of nuclease-free water.

Circularized amplicons were transformed into *E. coli* using a BTX ECM®630/HT-100 96-well electroporation apparatus (BTX, Harvard Apparatus). Electrocompetent W3110 *E. coli* cells (Agilent) were diluted with an equal volume of ice-cold sterile water. Then, 50 ul of the diluted cell suspension were added to a well with 3 ul of the circularized amplicon eluate and mixed. The mixture was transferred into an uncoated 96-well disposable electroporation plate with 2 mm-gap (BTX). The plate was chilled on ice, then pulsed using standard settings for *E. coli* transformation (2500 volts, 200Ω, 25 µf). Cells were recovered from the wells and added to 500 µl of S.O.C. recovery medium (Invitrogen; See, Hanahan, J. Mol. Biol., 166: 557-580 [1983]), followed by a 1 hr incubation with shaking at 37° C. to allow cell recovery and expression of the antibiotic resistance marker (chloramphenicol acetyltransferase) present on the reporter plasmid. After 1 hour of incubation, 500 µl of LB broth containing chloramphenicol (60 µg/ml) was added to the wells to select for the reporter plasmid during an overnight outgrowth at 30° C. or 37° C. Also at 1 hour, a portion of the outgrown cells was diluted 1:100 in LB, and 5 ul of the diluted culture was spotted via pipetting to LB$^+$ CAM$^+$ 1% (v/v) glucose plates to check transformation efficiency. Spots with 5 or more colonies contained at least 10$^5$ transformants; up to 10$^6$ transformants were observed for some wells. Blank control wells were inoculated with *E. coli* expressing the eGFP/dsRed reporter construct (SEQ ID NO: 18) and a positive control expressing eGFP alone.

The following day, plates were subcultured by the addition of 20 µl overnight culture into 380 µl of LB medium and grown with shaking at 30° C. After 2 hours of incubation, IPTG was added to each plate to a final concentration of 1 mM. The plates were incubated with shaking at 30° C. for 40-72 hours to allow for induction and full maturation of the wild-type dsRed protein. The induced cultures were pelleted by centrifugation, the supernatants decanted, and the cells were resuspended in 400 µl of 1×PBS by vortexing. Cells were further diluted 100-fold in PBS for flow cytometry analysis.

Cells were analyzed using an ACCURI™ C6 flow cytometer (BD Biosciences) with an autosampler, unless otherwise indicated in the tables below. Both eGFP and dsRed were excited via 488 nm laser, and fluorescence compensation was used to remove spectral overlap in the eGFP and dsRed emissions channels. Gates for single eGFP-expressing (green-only) and double eGFP/dsRed-expressing cells were defined using the corresponding control cultures on each plate. Typically, the background frequency of green-only events was 1×10$^{-5}$ in eGFP/dsRed-expressing control populations, whereas frequencies of 1×10$^{-3}$ to 3×10$^{-3}$ green-only events were observed for PCR-amplified populations using high-fidelity polymerases, so background subtraction was not applied. To minimize sampling error, wells were analyzed for a total of 500 green-only events or a maximum of 10$^6$ total events per samples. At a flow rate of 14 ul/min, this required between 15 to 4 minutes per sample, depending on the polymerase fidelity. The green-only frequency for each variant was calculated by dividing the fraction of gated green-only events by the total number of gated fluorescent cell events. The relative error rate for each variant was calculated by dividing the green-only frequency for the variant by the frequency for a parental control. Finally, the fold-improvement in polymerase fidelity reported in the tables below is the reciprocal of the relative error rate.

TABLE 4.1

Fidelity Improvements Relative to SEQ ID NO: 6

| SEQ ID NO: (nt/aa) | Amino Acid Differences (Relative to SEQ ID NO: 6) | Fidelity Improvement (Relative to SEQ ID NO: 6)[1] |
|---|---|---|
| 789/790 | R420Q | ++ |
| 791/792 | K515L | ++ |
| 793/794 | K521S | + |
| 95/96 | M257W | + |

[1]Levels of increased activity were determined relative to the reference polypeptide of SEQ ID NO: 6, and were defined as follows:
"+" = 2.01 to 3.1; and
"++" = 3.11 to 4.

TABLE 4.2

Fidelity Improvements Relative to SEQ ID NO: 22

| SEQ ID NO: (nt/aa) | Amino Acid Differences (Relative to SEQ ID NO: 22) | Fidelity Improvement (Relative to SEQ ID NO: 22)[1] |
|---|---|---|
| 795/796 | Y495N | +++ |
| 797/798 | M492V | +++ |
| 265/266 | Q497D | +++ |
| 289/290 | G401S | +++ |
| 291/292 | I281C | ++ |
| 273/274 | K490L | ++ |
| 799/800 | I488R | ++ |
| 801/802 | A702T/A743P | ++ |
| 281/282 | K482Q | ++ |
| 803/804 | K491D | ++ |
| 229/230 | T528S/K646R/E659D/R668L/A743P | + |
| 285/286 | K479P | + |
| 301/302 | F339M | + |
| 805/806 | K490Y | + |
| 269/270 | V277A | + |
| 275/276 | K480M | + |
| 807/808 | A743P | + |
| 271/272 | K482V | + |
| 809/810 | K391N/K491Q | + |
| 811/812 | G71D/S361M/A702T/S721R/K738V | + |

[1]Levels of increased activity were determined relative to the reference polypeptide of SEQ ID NO: 22, and were defined as follows:
"+" = 1.31 to 1.54 (first 50%);
"++" > 1.54 (next 30%); and
"+++" > 2.14 (top 20%).

TABLE 4.3

Fidelity Improvements Relative to SEQ ID NO: 24

| SEQ ID NO: (nt/aa) | Amino Acid Differences (Relative to SEQ ID NO: 24) | Fidelity Improvement (Relative to SEQ ID NO: 24)[1] |
|---|---|---|
| 645/646 | L370T | +++ |
| 559/560 | I539V | ++ |
| 669/670 | P385L | ++ |
| 563/564 | V550S/R575Q | ++ |
| 549/550 | K540G | + |
| 519/520 | K634R | + |
| 569/570 | R240A | + |

TABLE 4.3-continued

Fidelity Improvements Relative to SEQ ID NO: 24

| SEQ ID NO: (nt/aa) | Amino Acid Differences (Relative to SEQ ID NO: 24) | Fidelity Improvement (Relative to SEQ ID NO: 24)[1] |
|---|---|---|
| 813/814 | K540Q | + |
| 543/544 | T777D | + |

[1]Levels of increased activity were determined relative to the reference polypeptide of SEQ ID NO: 24, and were defined as follows:
"+" = 1.23 to 1.55 (first 50%);
"++" > 1.55 (next 30%); and
"+++" > 1.86 (top 20%).

TABLE 4.4

Fidelity Improvements Relative to SEQ ID NO: 28

| SEQ ID NO: (nt/aa) | Amino Acid Differences (Relative to SEQ ID NO: 28) | Fidelity Improvement (Relative to SEQ ID NO: 28)[1] |
|---|---|---|
| 815/816 | K515L | + |
| 817/818 | K515F | + |
| 819/820 | K482Q | + |
| 821/822 | Y390Q/K391G | + |

[1]Levels of increased activity were determined relative to the reference polypeptide of SEQ ID NO: 28, and were defined as follows:
"+" = 1.14 to 1.31.

TABLE 4.5

Fidelity Improvements Relative to SEQ ID NO: 26

| SEQ ID NO: (nt/aa) | Amino Acid Differences (Relative to SEQ ID NO: 26) | Fidelity Improvement (Relative to SEQ ID NO: 26)[1] |
|---|---|---|
| 823/824 | C281I | + |
| 825/826 | C281I/N579A | + |

[1]Levels of increased activity were determined relative to the reference peptide of SEQ ID NO: 26, and were defined as follows:
"+" = from 1 to 1.3.

Example 5

Relative Comparison of Polymerase Fidelity

The error rates of variant DNA polymerases were compared to those for commercially available DNA polymerases used in PCR, using the high-throughput flow cytometry assay. Variant polymerases from this study were used to amplify the fidelity reporter plasmid, and were assayed as described in Example 4. Commercially available polymerases were used to amplify the reporter construct using buffers supplied with the polymerase (no magnesium was added), and thermal cycling times and temperatures were used according to manufacturers' recommendations for a 4.5 kb plasmid template. The buffers used, concentration of dNTPs, annealing temperatures and extension times used for each polymerase are listed in Table 5.1. Error rates relative to PLATINUM SUPERFI™ DNA polymerase were calculated for each sample, and then relative error rates were calculated compared to Taq DNA polymerase in KCl buffer. FIG. 1 displays the relative error rates of these polymerases.

TABLE 5.1

Amplification Conditions for Polymerase Fidelity Comparisons

| Polymerase | Source | Buffer | [dNTPs] (µM) | Annealing temperature (° C.) | Extension time (min) |
|---|---|---|---|---|---|
| PLATINUM™ SUPERFI™ | ThermoFisher | supplied | 200 | 60 | 5 |
| Q5® High-Fidelity | NEB | supplied | 200 | 60 | 5 |
| PHUSION™ Hi-Fidelity | ThermoFisher | GC + 2% DMSO | 200 | 62 | 5 |
| PHUSION™ Hi-Fidelity | ThermoFisher | HF + 2% DMSO | 200 | 62 | 5 |
| KAPA HiFi | Roche/KAPA | supplied | 300 | 60 | 5 |
| Taq | ThermoFisher | KCl buffer | 200 | 55 | 6 |
| Taq | ThermoFisher | (NH$_4$)$_2$SO$_4$ buffer | 200 | 55 | 6 |
| Pfu ultra II Fusion HS | Agilent | supplied | 250 | 55 | 6 |

Example 6

Simultaneous Screening for Multiple Polymerase Traits

Robust polymerase performance across a range of applications was selected based on amplification of amplicons of varying size and GC content from plasmid and genomic DNA templates. Screening for subsequent rounds was performed in buffer M6a: 30 mM Tris pH 8.8, 10 mM (NH$_4$)$_2$SO$_4$, 13.2 mM KCl, 0.4% (v/v) Triton x-100, 0.5 mg/ml BSA, 1.5 mM MgSO4, 4.5% v/v DMSO. PCR conditions for the challenge conditions appear in Table 6.1. Product yield was determined as described in Example 3, via capillary electrophoresis, and fidelity was measured as described in Example 4. In these performance challenge experiments, different templates were used. Table 6.1 providese the reaction conditions, primers, and templates for each of the challenges. "ARX" refers to the human arx gene; "MCYP" refers to a microcyp' "KCL" refers to a challenge using the microcyp template, with additional KCl (4.5 mM); and "BRCA" refers to the human BRCA2 gene.

TABLE 6.1

PCR Conditions for Challenge Assays

| | ARX (79% GC) | MCYP | KCl challenge (MCYP) | BRCA | Fidelity |
|---|---|---|---|---|---|
| Additional KCl (mM) | 0 | 0 | 4.5 | 0 | 0 |
| # Cycles | 25 | 25 | 25 | 30 | 30 |
| Annealing temp (C.) | 54.8 | 53 | 53 | 58 | 60 |
| dNTPs, each (mM) | 0.2 | 0.2 | 0.2 | 0.2 | 0.2 |
| Extension temp (C.) | 72 | 72 | 72 | 72 | 72 |
| Extension time (m) | 2 | 2 | 2 | 4 | 5 |
| Forward primer | SEQ ID NO: 12 | SEQ ID NO: 10 | SEQ ID NO: 10 | SEQ ID NO: 1083 | SEQ ID NO: 19 |
| Reverse primer | SEQ ID NO: 13 | SEQ ID NO: 11 | SEQ ID NO: 11 | SEQ ID NO: 1084 | SEQ ID NO: 20 |
| Forward primer conc (nM, each) | 400 | 400 | 400 | 400 | 400 |
| Lysate % Vol (% (v/v)) | 2 | 2 | 2 | 2 | 2.5 |
| Template | Human Genomic DNA (SEQ ID NO: 8) | Plasmid DNA (SEQ ID NO: 7) | Plasmid DNA (SEQ ID NO: 7) | Human Genomic DNA (SEQ ID NO: 1085) | SEQ ID NO: 18 |
| Template conc (ng/uL) | 3.33 | 0.08 | 0.08 | 3.33 | 0.1 |
| Amplicon length (BP) | 500 bp | 2.9 kb | 2.9 kb | 4 kb | 4.5 kb |

TABLE 6.2

Polymerase Performance Relative to SEQ ID NO: 824

| SEQ ID NO: (nt/aa) | Amino Acid Differences (Relative to SEQ ID NO: 824) | ARX FIOP (Yield) | MCYP FIOP (Yield) | KCL challenge FIOP (Yield) | BRCA FIOP (Yield) | Fidelity FIOP |
|---|---|---|---|---|---|---|
| 827/828 | V80G | + | ++ | ++ | + | +++ |
| 829/830 | L783Q | + | ++ | ++ | + | +++ |
| 831/832 | I447V | + | + | + | + | +++ |
| 833/834 | P567G | + | + | + | + | +++ |
| 835/836 | I569T | + | + | ++ | ++ | +++ |
| 837/838 | V82Q | + | +++ | +++ | + | +++ |
| 839/840 | G564D/K572G | ++ | ++ | +++ | + | +++ |
| 841/842 | Y580A | + | + | + | + | +++ |
| 843/844 | I569T | +++ | + | ++ | + | +++ |
| 845/846 | L783R | ++ | + | ++ | ++ | ++ |
| 847/848 | E387S | + | + | + | + | ++ |
| 849/850 | I19S | + | + | + | + | ++ |
| 851/852 | E61A | | ++ | ++ | + | ++ |
| 853/854 | G297F | ++ | + | + | + | ++ |
| 855/856 | I569G | +++ | +++ | +++ | + | ++ |
| 857/858 | S196R | ++ | + | + | +++ | ++ |
| 859/860 | I118V | | + | ++ | ++ | ++ |
| 861/862 | Y667N | + | + | ++ | ++ | ++ |
| 863/864 | I569L | +++ | + | + | + | ++ |
| 865/866 | M537K | + | ++ | ++ | +++ | ++ |

TABLE 6.2-continued

Polymerase Performance Relative to SEQ ID NO: 824

| SEQ ID NO: (nt/aa) | Amino Acid Differences (Relative to SEQ ID NO: 824) | ARX FIOP (Yield) | MCYP FIOP (Yield) | KCL challenge FIOP (Yield) | BRCA FIOP (Yield) | Fidelity FIOP |
|---|---|---|---|---|---|---|
| 867/868 | I450V | +++ | + | ++ | + | + |
| 869/870 | Y191N | + | ++ | ++ | + | + |
| 871/872 | E313F | + | +++ | ++ | + | + |
| 873/874 | Y229S | + | + | + | ++ | + |
| 875/876 | L189G | ++ | ++ | + | +++ | + |
| 877/878 | F163P | + | ++ | + | +++ | + |
| 879/880 | F163A | + | ++ | + | +++ | + |
| 881/882 | P563L | + | +++ | +++ | + | + |
| 883/884 | Y191A | ++ | ++ | + | +++ | + |
| 885/886 | P563L | + | + | ++ | ++ | + |
| 887/888 | Y453R | + | ++ | ++ | +++ | + |
| 889/890 | E61R | +++ | + | + | ++ | + |
| 891/892 | A761P | +++ | +++ | +++ | + | + |
| 893/894 | F156R | +++ | ++ | ++ | + | + |
| 895/896 | K521V | + | ++ | +++ |  | + |
| 897/898 | F601I | + | ++ | +++ | ++ | + |
| 899/900 | V451Y | + | ++ | ++ | +++ | + |
| 901/902 | T619V | + | ++ | +++ | ++ | + |
| 903/904 | T314V | + | + | + | +++ | n.t. |
| 905/906 | G648F | ++ | + | ++ | +++ | n.t. |
| 907/908 | D469H | ++ | ++ | ++ | +++ | n.t. |
| 909/910 | D15W | ++ | ++ | +++ | +++ | n.t. |
| 911/912 | R575H | + | + | ++ | +++ | n.t. |
| 913/914 | L731G | + | + | + | +++ | n.t. |
| 915/916 | Y667T | + | + | + | +++ | n.t. |
| 917/918 | N221G | + | ++ | + | +++ | n.t. |
| 919/920 | G258L | + | + | + | +++ | n.t. |
| 921/922 | F163G |  | + | + | +++ | n.t. |
| 923/924 | S325Q |  | + | ++ | +++ | n.t. |
| 925/926 | W411T |  | + | + | +++ | n.t. |
| 927/928 | F274L | ++ | + | + | +++ | n.t. |
| 929/930 | F274V | +++ | ++ | + | +++ | n.t. |
| 931/932 | F163Q | ++ | + | + | +++ | n.t. |
| 933/934 | I231H | ++ | + | + | +++ | n.t. |
| 935/936 | R620K | ++ | ++ | +++ | ++ | n.t. |
| 937/938 | K719A | ++ | + | + | ++ | n.t. |
| 939/940 | F163W | + | + | + | ++ | n.t. |
| 941/942 | F274I | + | + | + | ++ | n.t. |
| 943/944 | N221G | ++ | ++ | ++ | ++ | n.t. |
| 945/946 | R377W | + | ++ | ++ | ++ | n.t. |
| 947/948 | F163W | + | + | + | ++ | n.t. |
| 949/950 | K81T | + | + | + | ++ | n.t. |
| 951/952 | F163K | +++ | + | + | ++ | n.t. |
| 953/954 | E502W | + | ++ | ++ | ++ | n.t. |
| 955/956 | Y580I | + | ++ | + | ++ | n.t. |
| 957/958 | I187L | ++ | +++ | +++ | ++ | n.t. |
| 959/960 | E162Q | + | +++ | + | ++ | n.t. |
| 961/962 | V208C | ++ | + | + | ++ | n.t. |
| 963/964 | V181R | ++ | + | + | ++ | n.t. |
| 965/966 | S317T | ++ | + | + | ++ | n.t. |
| 967/968 | I705L | ++ | + | + | ++ | n.t. |
| 969/970 | T619L | + | + | + | ++ | n.t. |
| 971/972 | K482V | + | + | + | ++ | n.t. |
| 973/974 | L52M | + | + | + | ++ | n.t. |
| 975/976 | V603R | + | ++ | ++ | ++ | n.t. |
| 977/978 | S317R | ++ | + | + | ++ | n.t. |
| 979/980 | I13T | ++ | + | + | ++ | n.t. |
| 981/982 | S325Q | + | +++ |  | ++ | n.t. |
| 983/984 | E141S | ++ | +++ | +++ | ++ | n.t. |
| 985/986 | E387A | + | ++ | +++ | ++ | n.t. |
| 987/988 | S317P | ++ | +++ | ++ | ++ | n.t. |
| 989/990 | Q772S | + | +++ | ++ | + | n.t. |
| 991/992 | S317P | ++ | +++ | +++ | + | n.t. |
| 993/994 | I758V | ++ | ++ | +++ | + | n.t. |
| 995/996 | R395H | ++ | +++ | + | + | n.t. |
| 997/998 | I111V | + | +++ | + | + | n.t. |
| 999/1000 | L394G | +++ | + | + | + | n.t. |
| 1001/1002 | S520C | +++ | ++ | + | + | n.t. |
| 1003/1004 | M326K | + | +++ | + | + | n.t. |
| 1005/1006 | D15G | +++ | + | ++ | + | n.t. |
| 1007/1008 | G778R | ++ | +++ | + | + | n.t. |
| 1009/1010 | A179G | ++ | + | +++ | + | n.t. |
| 1011/1012 | G778P | + | ++ | +++ | + | n.t. |

TABLE 6.2-continued

Polymerase Performance Relative to SEQ ID NO: 824

| SEQ ID NO: (nt/aa) | Amino Acid Differences (Relative to SEQ ID NO: 824) | ARX FIOP (Yield) | MCYP FIOP (Yield) | KCL challenge FIOP (Yield) | BRCA FIOP (Yield) | Fidelity FIOP |
|---|---|---|---|---|---|---|
| 1013/1014 | S774R | ++ | +++ | + | + | n.t. |
| 1015/1016 | D55K | +++ | + | + | + | n.t. |
| 1017/1018 | S196A | ++ | +++ | +++ | + | n.t. |
| 1019/1020 | R496S | + | +++ | +++ | + | n.t. |
| 1021/1022 | G564Q | ++ | ++ | ++ | + | n.t. |
| 1023/1024 | L148P | ++ | +++ | ++ | + | n.t. |
| 1025/1026 | V242L | ++ | +++ | ++ | + | n.t. |
| 1027/1028 | K784E | ++++ | + | ++ | + | n.t. |
| 1029/1030 | M537G | +++ | ++ | +++ | + | n.t. |
| 1031/1032 | E141R | ++ | +++ | +++ | + | n.t. |
| 1033/1034 | R575W | + | ++ | +++ | + | n.t. |
| 1035/1036 | L349I | + | ++ | +++ | + | n.t. |
| 1037/1038 | I26S | ++++ | + | + | + | n.t. |
| 1039/1040 | I690L | ++++ | + | ++ | + | n.t. |
| 1041/1042 | K775F | ++++ | + | ++ | + | n.t. |
| 1043/1044 | D55P | ++++ | + | + | + | n.t. |
| 1045/1046 | D469L | +++ | + | ++ | + | n.t. |
| 1047/1048 | Y333R | + | +++ | ++ | + | n.t. |
| 1049/1050 | K95R | + | +++ | + | + | n.t. |
| 1051/1052 | K775G | ++ | +++ | + | + | n.t. |
| 1053/1054 | G258S | +++ | | | + | n.t. |
| 1055/1056 | L394R | +++ | + | ++ | + | n.t. |
| 1057/1058 | R575W | ++ | + | +++ | + | n.t. |
| 1059/1060 | K673M | ++++ | + | + | + | n.t. |
| 1061/1062 | G258R | ++++ | + | ++ | + | n.t. |
| 1063/1064 | D152T | +++ | + | + | + | n.t. |
| 1065/1066 | I111A | +++ | + | + | + | n.t. |

ARX FIOP: Levels of increased activity were determined relative to the reference polypeptide of SEQ ID NO: 824, and were defined as follows: "+" .00 to .82 (first 50%); "++" >.82 (next 30%); "+++" >1.55 (top 20%); and "++++" >15 (top 7).
MCYP FIOP: Levels of increased activity were determined relative to the reference polypeptide of SEQ ID NO: 824, and were defined as follows: "+" .00 to .89 (first 50%); "++" >.89 (next 30%); and "+++" >1.49 (top 20%).
KCL challenge FIOP: Levels of increased activity were determined relative to the reference polypeptide of SEQ ID NO: 824, and were defined as follows: "+" .00 to .46 (first 50%); "++" >.46 (next 30%); and "+++" >1.86 (top 20%).
BRCA FIOP: Levels of increased activity were determined relative to the reference polypeptide of SEQ ID NO: 824. and were defined as follows: "+" .00 to 1.42 (first 50%); "++" >1.42 (next 30%); and "+++" >1.97 (top 20%).
Fidelity FIOP: Levels of replication fidelity were determined relative to the reference polypeptide of SEQ ID NO: 824, and were defined as follows: "+" .17 to .84 (first 50%); "++" >.84 (next 30%); and "+++" >1.42 (top 20%)

TABLE 6.3

Polymerase Peformance Relative to SEQ ID NO: 824

| SEQ ID NO: (nt/aa) | Amino Acid Differences (Relative to SEQ ID NO: 824) | ARX FIOP (Yield) | MCYP FIOP (Yield) | KCL challenge FIOP (Yield) | BRCA FIOP (Yield) | Fidelity FIOP |
|---|---|---|---|---|---|---|
| 1067/1068 | D15W/I447V/I569T/K775F/L783Q/K784E | ++ | + | ++ | + | + |
| 1069/1070 | T314V/I447V/I569T/L783Q/K784E | + | + | + | + | + |
| 1071/1072 | I569T | + | + | + | + | +++ |
| 1073/1074 | V82Q/V242L/I569L | + | ++ | + | + | +++ |
| 1075/1076 | E313F | ++ | ++ | ++ | ++ | ++ |
| 1077/1078 | M537K/Y667N | + | ++ | + | ++ | + |
| 1079/1080 | V82Q/I450V/P567G/I569G | +++ | +++ | +++ | +++ | + |
| 1081/1082 | P567G/I569G/Y667N | +++ | +++ | +++ | +++ | ++ |

ARX FIOP: Levels of increased activity were determined relative to the reference polypeptide of SEQ ID NO: 824, and were defined as follows: "+" .91 to 1.11 (first 50%); "++" >1.11 (next 30%); and "+++" >1.66 (top 20%).
MCYP Yield: Levels of increased activity were determined relative to the reference polypeptide of SEQ ID NO: 824, and were defined as follows: "+" .32 to 2.41 (first 50%); "++" >2.41 (next 30%); and "+++" >2.87 (top 20%).
KCL challenge: Levels of increased activity were determined relative to the reference polypeptide of SEQ ID NO: 824, and were defined as follows: "+" .03 to 1.27 (first 50%); "++" >1.27 (next 30%); and "+++" >1.53 (top 20%).
BRCA FIOP: Levels of increased activity were determined relative to the reference polypeptide of SEQ ID NO: 824, and were defined as follows: "+" .83 to 1.04 (first 50%); "++" >1.04 (next 30%); and "+++" >1.13 (top 20%).
Fidelity FIOP: Levels of replication fidelity (1/error rate) were determined relative to the reference polypeptide of SEQ ID NO: 824, and were defined as follows: "+" .64 to .71 (first 50%); "++" >.71 (next 30%); and "+++" >.86 (top 20%).

Example 7

Uniformity of Coverage in Next Generation Sequencing

Figure 2:
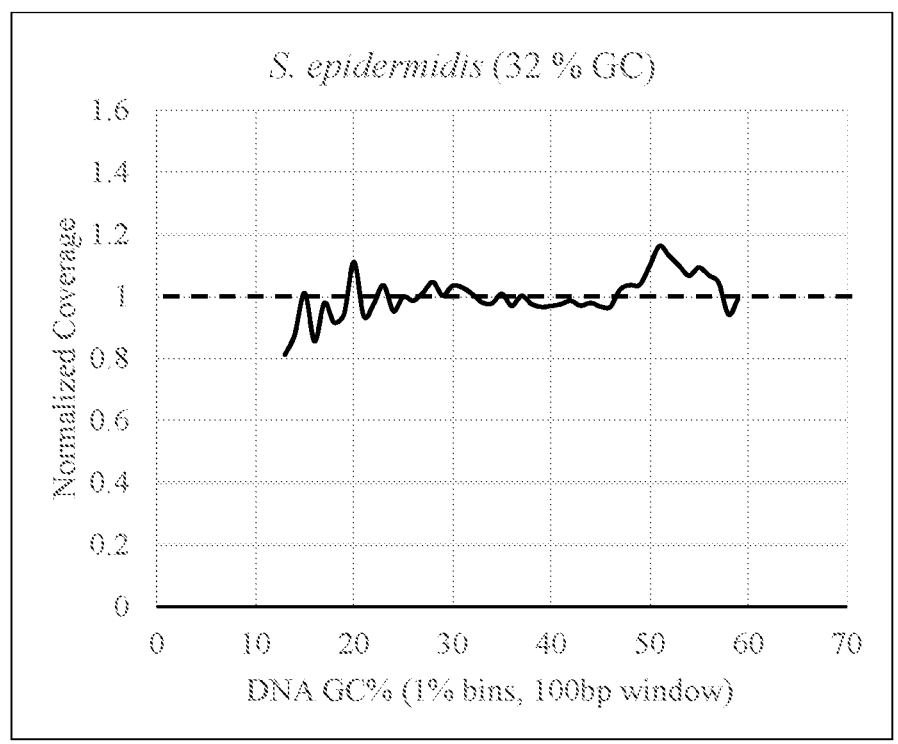
FIG. 2 provides a graph showing the uniformity of coverage for microbial whole genome resequencing for an organism with a low GC content (*Staphylococcus epidermidis*, 32% GC). Normalized coverage is plotted as a function of GC content for each genome. The theoretical ideal for normalized coverage is plotted as a dashed line (1.0).
Figure 3:
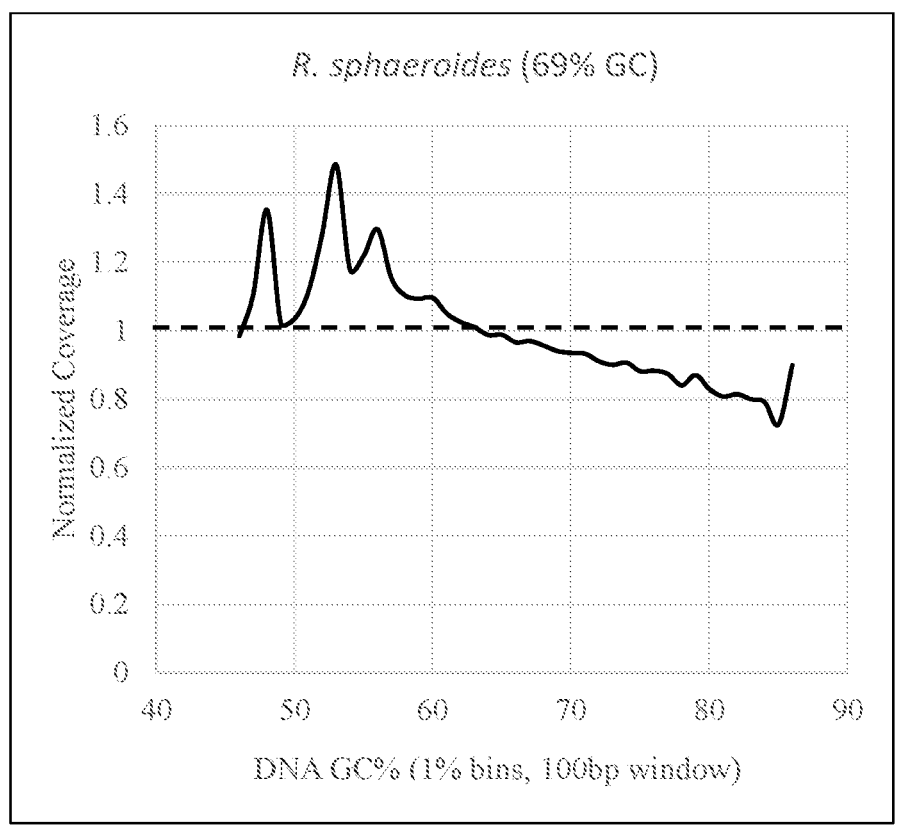
FIG. 3 provides a graph showing the uniformity of coverage for microbial whole genome resequencing for an organism with a high GC content (*Rhodobacter sphaeroides*, 69% GC). Normalized coverage is plotted as a function of GC content for each genome. The theoretical ideal for normalized coverage is plotted as a dashed line (1.0).

Whole genome sequencing of microbial genomes was used to test the uniformity of coverage of amplified libraries in next generation sequencing applications. Genomic DNA from two bacteria, *Staphylococcus epidermidis* (ATCC 12228: 2.5 MB, 32.1% GC) and *Rhodobacter sphaeroides* (ATCC 17025: 3.22 MB, 68.5% GC) were used in these experiments. The DNA from each organism was sheared to a 400 bp mean fragment length using sonication (Covaris). Then, 100 ng of genomic DNA was used as input into the KAPA Hyper library preparation workflow, using KAPA dual-indexed adapters, according to the manufacturer's instructions (Roche; product KR0961). Ligated library fragments were purified using MagBio HighPrep™ SPRI beads, and 10 ng of the input DNA was used as template for amplification for PCR using the purified polymerase of SEQ ID NO: 1082. Eight cycles of PCR amplification were performed in M34b buffer (30 mM Tris pH 8.8, 7 mM $(NH_4)_2SO_4$, 17 mM KCl, 0.05% (v/v) TWEEN®-20 surfactant, 0.5 mg/ml BSA, 2 mM $MgSO_4$, 8% v/v DMSO, 15 µM $ZnSO_4$). The amplified material was cleaned using HighPrep SPRI beads, normalized, and pooled for multiplexed sequencing. The library pool was sequenced on a MiSeq instrument (Illumina), using Miseq Reagent kit v2 (2×250 bp). Reads were demultiplexed, trimmed of adapter sequences, and then aligned to their respective genomes using CLC Genomics (Qiagen). CLC Genomics read mapping QC metrics were used to determine uniformity of coverage. FIGS. 2 and 3 provide the results of these experiments.

While the invention has been described with reference to the specific embodiments, various changes can be made and equivalents can be substituted to adapt to a particular situation, material, composition of matter, process, process step or steps, thereby achieving benefits of the invention without departing from the scope of what is claimed.

For all purposes in the United States of America, each and every publication and patent document cited in this disclosure is incorporated herein by reference as if each such publication or document was specifically and individually indicated to be incorporated herein by reference. Citation of publications and patent documents is not intended as an indication that any such document is pertinent prior art, nor does it constitute an admission as to its contents or date.

SEQUENCE LISTING (1085 sequences)

SEQ ID NO: 1 - DNA, 2325 bp, Artificial Sequence
  DNA polymerase
atgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgatgtggttgaaaaaatcgcgaagtaccgtgtgccgctggaaaagctggttattcacgagcaaatcacccgtgacctgaaagattataaggcgattggcccgcacgtgagcatcgcgaaacgtctggcgacccgtggtatcaaagtgaagccgggcaccatcattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaa

SEQ ID NO: 2 - protein, 774 aa, Artificial Sequence
  DNA polymerase
MILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 3 - DNA, 2325 bp, Artificial Sequence
  Pfu DNA polymerase
atgattctggatgttgactacatcaccgaagaaggcaaaccagttatccgcctgttcaaaaaagagaatggcaagttcaaaatcgagcatgaccgcacattccgcccgtacatttacgcactgctgcgcgacgattcgaagatcgaagaagtgaagaagattaccggtgaacgtcacggcaagattgtgcgtattgtggatgttgagaaggtggagaagaagttcctgggcaaaccgattaccgtgtggaaactgtatctggagcatccgcaggatgtccctaccattcgcgagaaagtccgtgaacatccggcagtcgtggatatttttgagtacgacatcccatttgcgaaacgctatctgattgacaaaggtctgattccgatggaaggggaagaagaattgaagattcttgcatttgacattgaaaccctgtaccacgaaggtgaagagtttggcaaaggtccgatcatcatgattagctacgcggatgagaacgaggcgaaagtcattacgtggaagaacattgacctgccatacgtagaggtcgtaagcagcgagcgcgagatgatcaaacgctttctgcgcatcattcgtgagaaagatccggacatcattgttacctacaacggcgatagcttcgatttcccctatctggccaaacgtgcagagaaactgggtatcaaactgaccatcggtcgcgatggtagcgaaccgaagatgcaacgcattggcgacatgaccgcggtggaagtaaagggtcgcattcatttcgatctgtatcatgtgattacccgcaccatcaatctgccgacctatactctggaagccgtgtatgaagctatcttcggcaaaccgaaagagaaagtgtatgcagatgagatcgcgaaagcgtgggaaagcggtgagaacctggaacgtgtggcgaagtactcgatggaagatgctaaagccacctacgagctgggcaaagagtttctgccgatggagatccagctgagccgtcttgttggtcagccactgtgggacgtgagccgcagcagtactggtaatcttgttgagtggttcctgctgcgtaaagcctatgaacgtaacgaagtggcgccgaacaaaccgagcgaagaagaataccagcgccgcctgcgcgaaagctataccggtggctttgtgaaagaaccagagaaaggtctgtgggagaacattgtgtatctggacttccgtgcactgtacccaagcatcatcattacccataacgtgagcccggacactctgaacctggaaggttgtaagaactatgacatcgcaccgcaggtgggtcataagttctgtaaagacattccgggcttcattccgagcctgctggggcacctgctggaagaacgccagaagatcaagacgaagatgaaagaaactcaggacccgattgagaagatcctgctggactatcgtcagaaagctatcaaactgctggctaacagcttctacggttactatggctatgcgaaagcgcgttggtattgcaaagaatgtgcggaaagcgttactgcatggggtcgcaagtacatcgaactggtttggaaagaactggaggagaagttcggcttcaaagttctgtacattgataccgatggtctgtacgccacaattccgggtggtgaatctgaagaaatcaagaagaaggcactggagttcgttaagtacatcaatagtaagctgccgggcctgctggaactggaatacgaaggtttctacaagcgcggcttctttgtgactaagaagcgctatgccgtgattgatgaagaaggcaaagtgattacccgcggtctggagattgtgcgtcgtgattggagcgagattgcgaaagaaacccaggctcgtgttctggaaaccatccttaagcatggcgatgttgaagaagccgtgcgcatcgtcaaagaagtaatccagaagttagccaactatgagattccaccagagaaactggccatctacgaacagattacccgccctttgcatgagtacaaagctattggtccgcatgtggcggttgcgaagaaactggccgcgaaaggagtaaagatcaaaccgggcatggtgattggctacatcgtgctgcgcggcgatggcccgattagcaatcgcgcaattctggccgaagaatacgatcctaagaagcacaagtatgatgctgagtactacatcgagaatcaggtgctgccagcagtactgcgcattctggaaggtttcggttaccgcaaagaagatctgcgctaccagaagacccgccaggttggtctgaccagctggcttaacatcaagaaatcc

SEQ ID NO: 4 - protein, 775 aa, Artificial Sequence
  Pfu DNA polymerase
MILDVDYITEEGKPVIRLFKKENGKFKIEHDRTFRPYIYALLRDDSKIEEVKKITGERHGKIVRIVDVEKVEKKFLGKPITVWKLYLEHPQDVPTIREKVREHPAVVDIFEYDIPFAKRYLIDKGLIPMEGEEELKILAFDIETLYHEGEEFGKGPIIMISYADENEAKVITWKNIDLPYVEVVSSEREMIKRFLRIIREKDPDIIVTYNGDSFDFPYLAKRAEKLGIKLTIGRDGSEPKMQRIGDMTAVEVKGRIHFDLYHVITRTINLPTYTLEAVYEAIFGKPKEKVYADEIAKAWESGENLERVAKYSMEDAKATYELGKEFLPMEIQLSRLVGQPLWDVSRSSTGNLVEWFLLRKAYERNEVAPNKPSEEEYQRRLRESYTGGFVKEPEKGLWENIVYLDFRALYPSIIITHNVSPDTLNLEGCKNYDIAPQVGHKFCKDIPGFIPSLLGHLLEERQKIKTKMKETQDPIEKILLDYRQKAIKLLANSFYGYYGYAKARWYCKECAESVTAWGRKYIELVWKELEEKFGFKVLYIDTDGLYATIPGGESEEIKKKALEFVKYINSKLPGLLELEYEGFYKRGFFVTKKRYAVIDEEGKVITRGLEIVRRDWSEIAKETQARVLETILKHGDVEEAVRIVKEVIQKLANYEIPPEKLAIYEQITRPLHEYKAIGPHVAVAKKLAAKGVKIKPGMVIGYIVLRGDGPISNRAILAEEYDPKKHKYDAEYYIENQVLPAVLRILEGFGYRKEDLRYQKTRQVGLTSWLNIKKS

SEQ ID NO: 5 - DNA, 2361 bp, Artificial Sequence
  Tagged DNA polymerase
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgatgtggttgaaaaaatcgcgaagtaccgtgtgccgctggaaaagctggttattcacgagcaaatcacccgtgacctgaaagattataaggcgattggcccgcacgtgagcatcgcgaaacgtctggcgacccgtggtatcaaagtgaagccgggcaccatcattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 6 - protein, 785 aa, Artificial Sequence
  Tagged DNA polymerase
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 7 - DNA, 3150 bp, Artificial Sequence
  MCYP plasmid DNA template
atgacaataaaggaaatgccgcagccgaaaacgtttggagaacttaaaaatttaccgttattaaacacagataaaccggttcaagctttgatgaaaattgcggatgaattaggagaaatctttaaattcgaggcgcctggttgtgtaacgcgctacttatcaagtcagcgtctaattaaagaagcatgcgatgaatcacgctttgataaaaacttaagtcaagcgcttaaatttgcacgtgattttctgggagacgggttagcaacaagctggacgcatgaaataaattggaaaaaagcgcataatatcttacttccaagctttagtcagcaggcaatgaaaggctatcatgcgatgatggtcgatatcgccgtgcagcttgttcaaaagtgggagcgtctaaatgcagatgagcatattgaagtatcggaagacatgacacgtttaacgcttgatacaattggtctttgcggctttaactatcgctttaacagcttttaccgagatcagcctcatccatttattataagtatggtccgtgcactggatgaagtaatgaacaagctgcagcgagcaaatccagacgacccagcttatgatgaaaacaagcgccagtgtcaagaagatatcaaggtgatgaacgacctagtagataaaattattgcagatcgcaaagcaaggggtgaacaaagcgatgatttattaacgcagatgctaaacggaaaagatccagaaacgggtgagccgcttgatgacgggaacattagctatcaaattattacattcttaattgcgggacacgaaacaacaagtggtcttttatcatttgcgctgtatttcttagtgaaaaatccacatgtattacaaaaagtagcagaagaagcagcacgagttctagtagatcctgttccaagctacaaacaagtcaaacagcttaaatatgtcggcatggtcttaaacgaagcgctgcgcttatggccaactgctcctgcgttttccctatatgcaaaagaagatacggtgcttggaggagaatatcctttagaaaaaggcgacgaagtaatggttctgattcctcagcttcaccgtgataaaacaatttggggagacgatgtggaggagttccgtccagagcgttttgaaaatccaagtgcgattccgcagcatgcgtttaaaccgtttggaaacggtcagcgtgcgtgtatcggtcagcagttcgctcttcatgaagcaacgctggtacttggtatgatgctaaaacactttgactttgaagatcatacaaactacgagctcgatattaaagaaactttaacgttaaaacctgaaggctttgtggtaaaagcaaaatcgaaaaaaattccgcttggcggtattccttcacctagcactgaacagtctgctaaaaaagtacgcaaaaaggcagaaaacgctcataatacgccgctgcttgtgctatacggttcaaatatgggaacagctgaaggaacggcgcgtgatttagcagatattgcaatgagcaaaggatttgcaccgcaggtcgcaacgcttgattcacacgccggaaatcttccgcgcgaaggagctgtattaattgtaacggcgtcttataacggtcatccgcctgataacgcaaagcaatttgtcgactggttagaccaagcgtctgctgatgaagtaaaaggcgttcgctactccgtatttggatgcggcgataaaaactgggctactacgtatcaaaaagtgcctgcttttatcgatgaaacgcttgccgctaaaggggcagaaaacatcgctgaccgcggtgaagcagatgcaagcgacgactttgaaggcacatatgaagaatggcgtgaacatatgtggagtgacgtagcagcctactttaacctcgacattgaaaacagtgaagataataaatctactctttcacttcaatttgtcgacagcgccgcggatatgccgcttgcgaaaatgcacggtgcgttttcaacgaacgtcgtagcaagcaaagaacttcaacagccaggcagtgcacgaagcacgcgacatcttgaaattgaacttccaaaagaagcttcttatcaagaaggagatcatttaggtgttattcctcgcaactatgaaggaatagtaaaccgtgtaacagcaaggttcggcctagatgcatcacagcaaatccgtctggaagcagaagaagaaaaattagctcatttgccactcgctaaaacagtatccgtagaagagcttctgcaatacgtggagcttcaagatcctgttacgcgcacgcagcttcgcgcaatggctgctaaaacggtctgcccgccgcataaagtagagcttgaagccttgcttgaaaagcaagcctacaaagaacaagtgctggcaaaacgtttaacaatgcttgaactgcttgaaaaatacccggcgtgtgaaatgaaattcagcgaatttatcgcccttctgccaagcatacgcccgcgctattactcgatttcttcatcacctcgtgtcgatgaaaaacaagcaagcatcacggtcagcgttgtctcaggagaagcgtggagcggatatggagaatataaaggaattgcgtcgaactatcttgccgagctgcaagaaggagatacgattacgtgctttatttccacaccgcagtcagaatttacgctgccaaaagaccctgaaacgccgcttatcatggtcggaccgggaacaggcgtcgcgccgtttagaggctttgtgcaggcgcgcaaacagctaaaagaacaaggacagtcacttggagaagcacatttatacttcggctgccgttcacctcatgaagactatctgtatcaagaagagcttgaaaacgcccaaagcgaaggcatcattacgcttcataccgctttttctcgcatgccaaatcagccgaaaacatacgttcagcacgtaatggaacaagacggcaagaaattgattgaacttcttgatcaaggagcgcacttctatatttgcggagacggaagccaaatggcacctgccgttgaagcaacgcttatgaaaagctatgctgacgttcaccaagtgagtgaagcagacgctcgcttatggctgcagcagctagaagaaaaaggccgatacgcaaaagacgtgtgggctgggtaa

SEQ ID NO: 8 - DNA, 658 bp, Artificial Sequence
  Human ARX template
ccaaggcgtcgaagtctggtggtgcgcggtccccgcacgcctgggcctaggcactgggggagcaactgcgggcgggccccggcagcagccctggctgggactccccggccggccggctggctgatagctctcccttgcccgcaggctcccctaagagcagcagcgccccgttcgaggccgagctgcacctgccgcccaagctgcggcgcctgtacggcccgggcgggggccgcctccttcagggtgcggcagcggcggcggcggcggcggcggcggcggcggcagcggccgccacggccacggcgggtccacgcggggaggcccctccgccgccaccgccaaccgcgcggcccggggaacggccggacggcgcaggggccgccgcggcagccgcggccgcggccgccgcggcctgggacacgctcaagatcagccaggcgccgcaggtgagcatcagccgcagcaagtcgtaccgcgagaacggggcgcccttcgtgccgccgccgcccgcgctggacgagctgggcggcccggggggcgtcacgcacccggaggagcgcctcggcgtggccggcggcccgggcagcgccccggctgcgggtggtggcaccggcaccgaggacgacgaggaggagctgctggaggacgaagaagatga

SEQ ID NO: 9 - DNA, 536 bp, Artificial Sequence
  Human beta globin template
ggttggccaatctactcccaggagcagggagggcaggagccagggctgggcataaaagtcagggcagagccatctattgcttacatttgcttctgacacaactgtgttcactagcaacctcaaacagacaccatggtgcacctgactcctgaggagaagtctgccgttactgccctgtggggcaaggtgaacgtggatgaagttggtggtgaggccctgggcaggttggtatcaaggttacaagacaggtttaaggagaccaatagaaactgggcatgtggagacagagaagactcttgggtttctgataggcactgactctctctgcctattggtctattttcccacccttaggctgctggtggtctacccttggacccagaggttctttgagtcctttggggatctgtccactcctgatgctgttatgggcaaccctaaggtgaaggctcatggcaagaaagtgctcggtgcctttagtgatggcctggctcacctggacaacctcaagggcacctttgccacactgagtgagc

SEQ ID NO: 10 - DNA, 30 bp, Artificial Sequence
  MCYP forward PCR primer
aattaggagaaatctttaaattcgaggcgc

SEQ ID NO: 11 - DNA, 24 bp, Artificial Sequence
  MCYP Rv primer
ttcttctagctgctgcagccataa

SEQ ID NO: 12 - DNA, 18 bp, Artificial Sequence
  ARX forward primer
ccaaggcgtcgaagtctg

SEQ ID NO: 13 - DNA, 20 bp, Artificial Sequence
  ARX Rv primer
tcatcttcttcgtcctccag

SEQ ID NO: 14 - DNA, 726 bp, Artificial Sequence
  eGFP
atggtaagcaaaggcgaagaattgtttacgggtgttgttccaatcctggttgaactggatggtgatgttaacggtcacaaatttagcgtgagcggcgaaggtgaaggcgatgcaacttatggcaaactgaccctgaaatttatttgcactacagggaaactgccggtgccgtggccaaccctggttaccaccctgacctatggcgttcagtgttttagccgctacccggaccacatgaagcagcacgattttttcaaaagcgcaatgccagaaggctatgtacaggaacgcaccatcttctttaaagatgatggcaactataaaacccgtgcggaagtcaaatttgaaggtgacaccctggttaatcgtattgaattgaaaggtattgattttaaagaagacggtaatatcctgggacataaactggagtataactataactcccacaatgtgtatatcatggcagataagcagaaaaacggcattaaggtgaatttcaaaattcgtcataatatcgaagatggtagtgtacagctggccgatcattaccagcagaataccccgatcggcgatggaccagtactgctgccggataatcattatctgagcacccagtcggctctgagcaaagatccgaacgaaaaacgcgaccacatggtactgctggagtttgttaccgccgctggtatcacactgggcatggatgagctgtataaatattaatga

SEQ ID NO: 15 - protein, 240 aa, Artificial Sequence
  eGFP
MVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYKY

SEQ ID NO: 16 - DNA, 675 bp, Artificial Sequence
  dsRed
atgcgtagcagcaaaaacgttattaaagaatttatgcgctttaaagtccgtatggaaggcacagtgaatggtcatgagtttgagatcgaaggtgaaggagaaggacgcccgtatgaaggtcacaataccgtgaagctgaaggtgactaaaggtggcccgttaccatttgcatgggacattctgagcccacagttccagtacggcagcaaggtctatgtgaaacacccggcggatattccggactacaagaagctgagctttccggaaggtttcaaatgggaacgtgttatgaacttcgaagatggtggtgtagtgactgttacccaggatagcagtttacaagacggctgcttcatctacaaggtgaagttcatcggtgtgaattttccgagcgatggcccggtcatgcaaaaaaagacgatggggtgggaagcaagtactgagcgcttatatccacgcgatggtgttttaaaaggggaaatccataaggcactgaagctgaaagacggcggtcattatctggtcgagttcaagagcatctacatggcgaaaaagccggtgcaactgccgggttattattatgttgactctaagctggacattacctctcataacgaagactataccatcgtggaacagtacgaacgcaccgaaggtcgccatcacctgttcctg

SEQ ID NO: 17 - protein, 225 aa, Artificial Sequence
  dsRed
MRSSKNVIKEFMRFKVRMEGTVNGHEFEIEGEGEGRPYEGHNTVKLKVTKGGPLPFAWDILSPQFQYGSKVYVKHPADIPDYKKLSFPEGFKWERVMNFEDGGVVTVTQDSSLQDGCFIYKVKFIGVNFPSDGPVMQKKTMGWEASTERLYPRDGVLKGEIHKALKLKDGGHYLVEFKSIYMAKKPVQLPGYYYVDSKLDITSHNEDYTIVEQYERTEGRHHLFL

SEQ ID NO: 18 - DNA, 4601 bp, Artificial Sequence
  Fidelity reporter plasmid
tcgagttaattaaggcagtgagcgcaacgcaattaatgtgagttagctcactcattaggcaccccaggctttacactttatgcttccggctcgtatgttgtgtggaattgtgagcggataacaatttcacacaggaaacggctatgaccatgattacggattcactggccgtcgttttacaatctagaggccagcctggccataaggagatatacatatggtaagcaaaggcgaagaattgtttacgggtgttgttccaatcctggttgaactggatggtgatgttaacggtcacaaatttagcgtgagcggcgaaggtgaaggcgatgcaacttatggcaaactgaccctgaaatttatttgcactacagggaaactgccggtgccgtggccaaccctggttaccaccctgacctatggcgttcagtgttttagccgctacccggaccacatgaagcagcacgattttttcaaaagcgcaatgccagaaggctatgtacaggaacgcaccatcttctttaaagatgatggcaactataaaacccgtgcggaagtcaaatttgaaggtgacaccctggttaatcgtattgaattgaaaggtattgattttaaagaagacggtaatatcctgggacataaactggagtataactataactcccacaatgtgtatatcatggcagataagcagaaaaacggcattaaggtgaatttcaaaattcgtcataatatcgaagatggtagtgtacagctggccgatcattaccagcagaataccccgatcggcgatggaccagtactgctgccggataatcattatctgagcacccagtcggctctgagcaaagatccgaacgaaaaacgcgaccacatggtactgctggagtttgttaccgccgctggtatcacactgggcatggatgagctgtataaatattaatgaggccaaactggccaccatcaccatcaccattagggaagagcagatgggcaagcttaaggagataatactatgcgtagcagcaaaaacgttattaaagaatttatgcgctttaaagtccgtatggaaggcacagtgaatggtcatgagtttgagatcgaaggtgaaggagaaggacgcccgtatgaaggtcacaataccgtgaagctgaaggtgactaaaggtggcccgttaccatttgcatgggacattctgagcccacagttccagtacggcagcaaggtctatgtgaaacacccggcggatattccggactacaagaagctgagctttccggaaggtttcaaatgggaacgtgttatgaacttcgaagatggtggtgtagtgactgttacccaggatagcagtttacaagacggctgcttcatctacaaggtgaagttcatcggtgtgaattttccgagcgatggcccggtcatgcaaaaaaagacgatggggtgggaagcaagtactgagcgcttatatccacgcgatggtgttttaaaaggggaaatccataaggcactgaagctgaaagacggcggtcattatctggtcgagttcaagagcatctacatggcgaaaaagccggtgcaactgccgggttattattatgttgactctaagctggacattacctctcataacgaagactataccatcgtggaacagtacgaacgcaccgaaggtcgccatcacctgttcctgtaatgaaagcttgacctgtgaagtgaaaaatggcgcacattgtgcgacatttttttttgaattctacgtaaaaagccgccgatacatcggctgctttttttttgatagaggttcaaacttgtggtataatgaaataagatcactccggggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctgtggagcgagtatcatgatgactttcgccaattcctgcatatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaactgcaggagctcaaacagcagcctgtattcaggctgcttttttcgttttggtctgcgcgtaatctcttgctctgaaaacgaaaaaaccgccttgcagggcggtttttcgaaggttctctgagctaccaactctttgaaccgaggtaactggcttggaggagcgcagtcaccaaaacttgtcctttcagtttagccttaaccggcgcatgacttcaagactaactcctctaaatcaattaccagtggctgctgccagtggtgcttttgcatgtctttccgggttggactcaagacgatagttaccggataaggcgcagcggtcggactgaacggggggttcgtgcatacagtccagcttggagcgaactgcctacccggaactgagtgtcaggcgtggaatgagacaaacgcggccataacagcggaatgacaccggtaaaccgaaaggcaggaacaggagagcgcacgagggagccgccagggggaaacgcctggtatctttatagtcctgtcgggtttcgccaccactgatttgagcgtcagatttcgtgatgcttgtcaggggggcggagcctatggaaaaacggctttgccgcggccctctcacttccctgttaagtatcttcctggcatcttccaggaaatctccgccccgttcgtaagccatttccgctcgccgcagtcgaacgaccgagcgtagcgagtcagtgagcgaggaagcggaatatatcctgtatcacatattctgctgacgcaccggtgcagccttttttctcctgccacatgaagcacttcactgacaccctcatcagtgaaccaccgctggtagcggtggtttttttaggcctatggccttttttttttgtgggaaacctttcgcggtatggtattaaagcgcccggaagagagtcaattcagggtggtgaatgtgaaaccagtaacgttatacgatgtcgcagagtatgccggtgtctcttatcagaccgtttcccgcgtggtgaaccaggccagccacgtttctgcgaaaacgcgggaaaaagtggaagcggcgatggcggagctgaattacattcccaaccgcgtggcacaacaactggcgggcaaacagtcgttgctgattggcgttgccacctccagtctggccctgcacgcgccgtcgcaaattgtcgcggcgattaaatctcgcgccgatcaactgggtgccagcgtggtggtgtcgatggtagaacgaagcggcgtcgaagcctgtaaagcggcggtgcacaatcttctcgcgcaacgcgtcagtgggctgatcattaactatccgctggatgaccaggatgccattgctgtggaagctgcctgcactaatgttccggcgttatttcttgatgtctctgaccagacacccatcaacagtattattttctcccatgaagacggtacgcgactgggcgtggagcatctggtcgcattgggtcaccagcaaatcgcgctgttagcgggcccattaagttctgtctcggcgcgtctgcgtctggctggctggcataaatatctcactcgcaatcaaattcagccgatagcggaacgggaaggcgactggagtgccatgtccggttttcaacaaaccatgcaaatgctgaatgagggcatcgtttccactgcgatgctggttgccaacgatcagatggcgctgggcgcaatgcgcgccattaccgagtccgggctgcgcgttggtgcggacatctcggtagtgggatacgacgataccgaagacagctcatgttatatcccgccgttaaccaccatcaaacaggattttcgcctgctggggcaaaccagcgtggaccgcttgctgcaactctctcagggccaggcggttaagggcaatcagctgttgcccgtctcactggtgaaaagaaaaaccaccctggcgcccaatacgcaaaccgcctctccccgcgcgttggccgattcattaatgcagctggcacgacaggtttcccgactggaaagcgggcagtgagcggtacccgataaaagcggcttcctgacaggaggccgttttgtttc

SEQ ID NO: 19 - DNA, 21 bp, Artificial Sequence
  Reporter forward primer
gactttcgccaattcctgcat

SEQ ID NO: 20 - DNA, 21 bp, Artificial Sequence
  Reporter reverse primer
atcatgatactcgctccacag

SEQ ID NO: 21 - DNA, 2361 bp, Artificial Sequence
  DNA polymerase variant
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctgaaagattataaggcgattggcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacgcggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 22 - protein, 785 aa, Artificial Sequence
  DNA polymerase variant
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLKDYKAIGPHVSIAKRLAARGIKVKPGTIISYLVLKGSGKISDRVILLTEYDPEKHKYDADYYIENQVLPAVLRILEAFGYRKEDLRYQSSKQTGLDTWLKR

SEQ ID NO: 23 - DNA, 2355 bp, Artificial Sequence
  DNA polymerase variant
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 24 - protein, 785 aa, Artificial Sequence
  DNA polymerase variant
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 25 - DNA, 2355 bp, Artificial Sequence
  DNA polymerase variant
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtacctgcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 26 - protein, 785 aa, Artificial Sequence
  DNA polymerase variant
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTCNLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 27 - DNA, 2355 bp, Artificial Sequence
  DNA polymerase variant
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcctgcctaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcgactcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 28 - protein, 785 aa, Artificial Sequence
  DNA polymerase variant
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEILPKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 29 - DNA, 2361 bp, Artificial Sequence
  Rd1 MYCP combis
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacgaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgatgtggttgaaaaaatcgcgaagtaccgtgtgccgccggaaaagctggttattcacgagcaaatcacccgtgacctgaaagattataaggcgattggcccgcacgtgagcatcgcgaaacgtctggcgacccgtggtatcaaagtgaagccgggcaccatcattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 30 - protein, 785 aa, Artificial Sequence
  Rd1 MYCP combis
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYERRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPPEKLVIHEQITRDLKDYKAIGPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 31 - DNA, 2361 bp, Artificial Sequence
  Rd1 MYCP combis
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacatgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaacacggtagcgttgaaaaggcggtggagattgttcgtgatgtggttgaaaaaatcgcgaagtaccgtgtgccgctggaaaagctggttattcacgagcaaatcacccgtgacctgaaagattataaggcgattggcccgcacgtgagcatcgcgaaacgtctggcggcccgtggtatcaaagtgaagccgggcaccattattagctacctggttctgaaaggtagcggcaagattagcgaccgtgttatcctgctgaccgaatacgatccggagaaacacaagtatgacgcggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 32 - protein, 785 aa, Artificial Sequence
  Rd1 MYCP combis
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINMPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKHGSVEKAVEIVRDVVEKIAKYRVPLEKLVIHEQITRDLKDYKAIGPHVSIAKRLAARGIKVKPGTIISYLVLKGSGKISDRVILLTEYDPEKHKYDADYYIENQVLPAVLRILEAFGYRKEDLRYQSSKQTGLDTWLKR

SEQ ID NO: 33 - DNA, 2361 bp, Artificial Sequence
  Rd1 MYCP combis
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaacacggtagcgttgaaaaggcggtggagattgttcgtgaggtgactgaaaaactggcgaagtacgaggtgccgctggaaaagctggttattcacgagcaaatcacccgtgacctgaaagattataaggcgattggcccgcacgtgagcatcgcgaaacgtctggcggctcgtggtatcaaagtgaagccgggcaccatcattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 34 - protein, 785 aa, Artificial Sequence
  Rd1 MYCP combis
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKHGSVEKAVEIVREVTEKLAKYEVPLEKLVIHEQITRDLKDYKAIGPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 35 - DNA, 2361 bp, Artificial Sequence
  Rd1 MYCP combis
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaacacggtagcgttgaaaaggcggtggagattgttcgtgaggtggtcgaaaaaatcgcgaagtacgaggtgccgccggaaaagctggttattcacgagcaaatcacccgtgacctgaaagattataaggcgattggcccgcacgtgagcatcgcgaaacgtctggcgacccgtggtatcaaagtgaagccgggcaccattattagctacatcgttctgaaaggtagcggcaagattagcgaccgtgctatcctgctgactgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 36 - protein, 785 aa, Artificial Sequence
  Rd1 MYCP combis
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKHGSVEKAVEIVREVVEKIAKYEVPPEKLVIHEQITRDLKDYKAIGPHVSIAKRLATRGIKVKPGTIISYIVLKGSGKISDRAILLTEYDPEKHKYDPDYYIENQVLPAVLRILEAFGYRKEDLRYQSSKQTGLDTWLKR

SEQ ID NO: 37 - DNA, 2361 bp, Artificial Sequence
  Rd1 MYCP combis
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacgaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaacacggtagcgttgaaaaggcggtggagattgttcgtgacgtggtcgaaaaaatcgcgaagtaccgtgtgccgccggaaaagctggttattcacgagcaaatcacccgtgacctgaaagattataaggcgattggcccgcacgtgagcatcgcgaaacgtctggcgacccgtggtatcaaagtgaagccgggcaccatcattagctacctggttctgaaaggtagcggcaagattagcgaccgtgctatcctgctgactgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 38 - protein, 785 aa, Artificial Sequence
  Rd1 MYCP combis
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYERRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKHGSVEKAVEIVRDVVEKIAKYRVPPEKLVIHEQITRDLKDYKAIGPHVSIAKRLATRGIKVKPGTIISYLVLKGSGKISDRAILLTEYDPEKHKYDPDYYIENQVLPAVLRILEAFGYRKEDLRYQSSKQTGLDTWLKR

SEQ ID NO: 39 - DNA, 2361 bp, Artificial Sequence
  Rd1 MYCP combis
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgatgtggttgaaaaaatcgcgaagtaccgtgtgccgccggaaaagctggttattcacgagcaaatcacccgtgacctgaaagattataaggcgattggcccgcacgtgagcatcgcgaaacgtctggcggctcgtggtatcaaagtgaagccgggcaccatcattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 40 - protein, 785 aa, Artificial Sequence
  Rd1 MYCP combis
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPPEKLVIHEQITRDLKDYKAIGPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 41 - DNA, 2361 bp, Artificial Sequence
  Rd1 MYCP combis
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacgaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgatgtggttgaaaaaatcgcgaagtaccgtgtgccgctggaaaagctggttattcacgagcaaatcacccgtgacctgaaagattataaggcgattggcccgcacgtgagcatcgcgaaacgtctggcgacccgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 42 - protein, 785 aa, Artificial Sequence
  Rd1 MYCP combis
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYERRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 43 - DNA, 2361 bp, Artificial Sequence
  Rd1 MYCP combis
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtacgaggtgccgctggaaaagctggttattcacgagcaaatcacccgtgacctgaaagattataaggcgattggcccgcacgtgagcatcgcgaaacgtctggcggctcgtggtatcaaagtgaagccgggcaccatcattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 44 - protein, 785 aa, Artificial Sequence
  Rd1 MYCP combis
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYEVPLEKLVIHEQITRDLKDYKAIGPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 45 - DNA, 2361 bp, Artificial Sequence; identical to SEQ ID NO: 21
  Rd1 MYCP combis

SEQ ID NO: 46 - protein, 785 aa, Artificial Sequence; identical to SEQ ID NO: 22
  Rd1 MYCP combis

SEQ ID NO: 47 - DNA, 2361 bp, Artificial Sequence
  Rd1 MYCP combis
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacgaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctgaaagattataaggcgattggcccgcacgtgagcatcgcgaaacgtctggcggctcgtggtatcaaagtgaagccgggcaccattattagctacatcgttctgaaaggtagcggcaagattagcgaccgtgttatcctgctggaggaatacgatccgcgtaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 48 - protein, 785 aa, Artificial Sequence
  Rd1 MYCP combis
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYERRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLKDYKAIGPHVSIAKRLAARGIKVKPGTIISYIVLKGSGKISDRVILLEEYDPRKHKYDPDYYIENQVLPAVLRILEAFGYRKEDLRYQSSKQTGLDTWLKR

SEQ ID NO: 49 - DNA, 2361 bp, Artificial Sequence
  Rd1 MYCP combis
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacgaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaacacggtagcgttgaaaaggcggtggagattgttcgtgaggtgactgaaaaaatcgcgaagtacgaggtgccgccggaaaagctggttattcacgagcaaatcacccgtgacctgaaagattataaggcgattggcccgcacgtgagcatcgcgaaacgtctggcgactcgtggtatcaaagtgaagccgggcaccgttattagctacatcgttctgaaaggtagcggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 50 - protein, 785 aa, Artificial Sequence
  Rd1 MYCP combis
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYERRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKHGSVEKAVEIVREVTEKIAKYEVPPEKLVIHEQITRDLKDYKAIGPHVSIAKRLATRGIKVKPGTVISYIVLKGSGKISDRVILLTEYDPEKHKYDPDYYIENQVLPAVLRILEAFGYRKEDLRYQSSKQTGLDTWLKR

SEQ ID NO: 51 - DNA, 2361 bp, Artificial Sequence
  Rd1 MYCP combis
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaacacggtagcgttgaaaaggcggtggagattgttcgtgatgtggtcgaaaaaatcgcgaagtacgaggtgccgctggaaaagctggttattcacgagcaaatcacccgtgacctgaaagattataaggcgattggcccgcacgtgagcatcgcgaaacgtctggcgacccgtggtatcaaagtgaagccgggcaccatcattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 52 - protein, 785 aa, Artificial Sequence
  Rd1 MYCP combis
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKHGSVEKAVEIVRDVVEKIAKYEVPLEKLVIHEQITRDLKDYKAIGPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 53 - DNA, 2361 bp, Artificial Sequence
  Rd1 MYCP combis
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacgaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgatgtggttgaaaaaatcgcgaagtaccgtgtgccgctggaaaagctggttattcacgagcaaatcacccgtgacctgaaagattataaggcgattggcccgcacgtgagcatcgcgaaacgtctggcggctcgtggtatcaaagtgaagccgggcaccgttattagctacatcgttctgaaaggtagcggcaagattagcgaccgtgttatcctgctggaggaatacgatccggagaaacacaagtatgacgcggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 54 - protein, 785 aa, Artificial Sequence
  Rd1 MYCP combis
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYERRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLAARGIKVKPGTVISYIVLKGSGKISDRVILLEEYDPEKHKYDADYYIENQVLPAVLRILEAFGYRKEDLRYQSSKQTGLDTWLKR

SEQ ID NO: 55 - DNA, 2361 bp, Artificial Sequence
  Rd1 MYCP combis
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaacacggtagcgttgaaaaggcggtggagattgttcgtgaggtggtcgaaaaactggcgaagtacgaggtgccgctggaaaagctggttattcacgagcaaatcacccgtgacctgaaagattataaggcgattggcccgcacgtgagcatcgcgaaacgtctggcggctcgtggtatcaaagtgaagccgggcaccgttattagctacctggttctgaaaggtagcggcaagattagcgaccgtgttatcctgctgactgaatacgatccgcgtaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 56 - protein, 785 aa, Artificial Sequence
  Rd1 MYCP combis
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKHGSVEKAVEIVREVVEKLAKYEVPLEKLVIHEQITRDLKDYKAIGPHVSIAKRLAARGIKVKPGTVISYLVLKGSGKISDRVILLTEYDPRKHKYDPDYYIENQVLPAVLRILEAFGYRKEDLRYQSSKQTGLDTWLKR

SEQ ID NO: 57 - DNA, 2361 bp, Artificial Sequence
  Rd1 MYCP combis
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgatgtggttgaaaaaatcgcgaagtaccgtgtgccgccggaaaagctggttattcacgagcaaatcacccgtgacctgaaagattataaggcgattggcccgcacgtgagcatcgcgaaacgtctggcggctcgtggtatcaaagtgaagccgggcaccattattagctacatcgttctgaaaggtagcggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 58 - protein, 785 aa, Artificial Sequence
  Rd1 MYCP combis
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPPEKLVIHEQITRDLKDYKAIGPHVSIAKRLAARGIKVKPGTIISYIVLKGSGKISDRVILLTEYDPEKHKYDPDYYIENQVLPAVLRILEAFGYRKEDLRYQSSKQTGLDTWLKR

SEQ ID NO: 59 - DNA, 2361 bp, Artificial Sequence
  Rd1 MYCP combis
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacgaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaacacggtagcgttgaaaaggcggtggagattgttcgtgaggtgactgaaaaaatcgcgaagtacgaggtgccgccggaaaagctggttattcacgagcaaatcacccgtgacctgaaagattataaggcgattggcccgcacgtgagcatcgcgaaacgtctggcgactcgtggtatcaaagtgaagccgggcaccattattagctacatcgttctgaaaggtagcggcaagattagcgaccgtgttatcctgctgactgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 60 - protein, 785 aa, Artificial Sequence
  Rd1 MYCP combis
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYERRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKHGSVEKAVEIVREVTEKIAKYEVPPEKLVIHEQITRDLKDYKAIGPHVSIAKRLATRGIKVKPGTIISYIVLKGSGKISDRVILLTEYDPEKHKYDPDYYIENQVLPAVLRILEAFGYRKEDLRYQSSKQTGLDTWLKR

SEQ ID NO: 61 - DNA, 2361 bp, Artificial Sequence
  Rd1 MYCP combis
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaacacggtagcgttgaaaaggcggtggagattgttcgtgatgtggttgaaaaaatcgcgaagtacgaggtgccgccggaaaagctggttattcacgagcaaatcacccgtgacctgaaagattataaggcgattggcccgcacgtgagcatcgcgaaacgtctggcgacccgtggtatcaaagtgaagccgggcaccgttattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 62 - protein, 785 aa, Artificial Sequence
  Rd1 MYCP combis
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKHGSVEKAVEIVRDVVEKIAKYEVPPEKLVIHEQITRDLKDYKAIGPHVSIAKRLATRGIKVKPGTVISYLVLKGSGKISDRVILLTEYDPEKHKYDPDYYIENQVLPAVLRILEAFGYRKEDLRYQSSKQTGLDTWLKR

SEQ ID NO: 63 - DNA, 2361 bp, Artificial Sequence
  Rd1 MYCP combis
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacgaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaacacggtagcgttgaaaaggcggtggagattgttcgtgaggtggtcgaaaaactggcgaagtacgaggtgccgctggaaaagctggttattcacgagcaaatcacccgtgacctgaaagattataaggcgattggcccgcacgtgagcatcgcgaaacgtctggcggctcgtggtatcaaagtgaagccgggcaccatcattagctacctggttctgaaaggtagcggcaagattagcgaccgtgctatcctgctggaggaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 64 - protein, 785 aa, Artificial Sequence
  Rd1 MYCP combis
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYERRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKHGSVEKAVEIVREVVEKLAKYEVPLEKLVIHEQITRDLKDYKAIGPHVSIAKRLAARGIKVKPGTIISYLVLKGSGKISDRAILLEEYDPEKHKYDPDYYIENQVLPAVLRILEAFGYRKEDLRYQSSKQTGLDTWLKR

SEQ ID NO: 65 - DNA, 2361 bp, Artificial Sequence
  Rd1 MYCP combis
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgatgtggttgaaaaaatcgcgaagtaccgtgtgccgctggaaaagctggttattcacgagcaaatcacccgtgacctgaaagattataaggcgattggcccgcacgtgagcatcgcgaaacgtctggcgactcgtggtatcaaagtgaagccgggcaccatcattagctacctggttctgaaaggtagcggcaagattagcgaccgtgttatcctgctgaccgaatacgatccggagaaacacaagtatgacgcggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 66 - protein, 785 aa, Artificial Sequence
  Rd1 MYCP combis
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGSGKISDRVILLTEYDPEKHKYDADYYIENQVLPAVLRILEAFGYRKEDLRYQSSKQTGLDTWLKR

SEQ ID NO: 67 - DNA, 2361 bp, Artificial Sequence
  Rd1 MYCP combis
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacgaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaacacggtagcgttgaaaaggcggtggagattgttcgtgacgtgactgaaaaactggcgaagtaccgtgtgccgccggaaaagctggttattcacgagcaaatcacccgtgacctgaaagattataaggcgattggcccgcacgtgagcatcgcgaaacgtctggcggctcgtggtatcaaagtgaagccgggcaccattattagctacatcgttctgaaaggtagcggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 68 - protein, 785 aa, Artificial Sequence
  Rd1 MYCP combis
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYERRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKHGSVEKAVEIVRDVTEKLAKYRVPPEKLVIHEQITRDLKDYKAIGPHVSIAKRLAARGIKVKPGTIISYIVLKGSGKISDRVILLTEYDPEKHKYDPDYYIENQVLPAVLRILEAFGYRKEDLRYQSSKQTGLDTWLKR

SEQ ID NO: 69 - DNA, 2361 bp, Artificial Sequence
  Rd1 MYCP combis
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaagctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgctggagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgatgtggttgaaaaaatcgcgaagtaccgtgtgccgctggaaaagctggttattcacgagcaaatcacccgtgacctgaaagattataaggcgattggcccgcacgtgagcatcgcgaaacgtctggcgacccgtggtatcaaagtgaagccgggcaccatcattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 70 - protein, 785 aa, Artificial Sequence
  Rd1 MYCP combis
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTIKLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKALEFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 71 - DNA, 2361 bp, Artificial Sequence
  Rd1 MYCP combis
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacgaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaacacggtagcgttgaaaaggcggtggagattgttcgtgaggtggtcgaaaaactggcgaagtaccgtgtgccgccggaaaagctggttattcacgagcaaatcacccgtgacctgaaagattataaggcgattggcccgcacgtgagcatcgcgaaacgtctggcggctcgtggtatcaaagtgaagccgggcaccatcattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 72 - protein, 785 aa, Artificial Sequence
  Rd1 MYCP combis
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYERRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKHGSVEKAVEIVREVVEKLAKYRVPPEKLVIHEQITRDLKDYKAIGPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 73 - DNA, 2361 bp, Artificial Sequence
  Rd1 MYCP combis
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacgaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtgactgaaaaactggcgaagtacgaggtgccgccggaaaagctggttattcacgagcaaatcacccgtgacctgaaagattataaggcgattggcccgcacgtgagcatcgcgaaacgtctggcgacccgtggtatcaaagtgaagccgggcaccattattagctacatcgttctgaaaggtagcggcaagattagcgaccgtgttatcctgctgaccgaatacgatccgcgtaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 74 - protein, 785 aa, Artificial Sequence
  Rd1 MYCP combis
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYERRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVTEKLAKYEVPPEKLVIHEQITRDLKDYKAIGPHVSIAKRLATRGIKVKPGTIISYIVLKGSGKISDRVILLTEYDPRKHKYDPDYYIENQVLPAVLRILEAFGYRKEDLRYQSSKQTGLDTWLKR

SEQ ID NO: 75 - DNA, 2361 bp, Artificial Sequence
  Rd1 MYCP combis
atgcatcaccatcaccatcacggtggcagcggtatgattctggacaccgattacatcaccgaagatggcaagccgatcattcgtattttcaagaaagaaaacggcgagtttaagatcgagctggacccgcactttcagccgtacatttatgcgctgctgaaagacgatagcgcgatcgaggaaattaaagcgatcacgggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacggggaaaacccggagccgaagatccaacgtatgggtgatagcttcgcggtggagattaaaggccgtatccacttcgacctgtttccggtggttcgtcgtaccatccgtctgccgacctacaccctggaagcggtgtatgaggcggttctgggcaagaccaaaagcaagctgggcgcggaagagattgcggcgatctgggagaccgaagagagcatgaaaaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgcgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgatgtggttgaaaaaatcgcgaagtaccgtgtgccgctggaaaagctggttattcacgagcaaatcacccgtgacctgaaagattataaggcgattggcccgcacgtgagcatcgcgaaacgtctggcgacccgtggtatcaaagtgaagccgggcaccatcattagctacctggttctgaaaggtagcggcaagattagcgatcgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 76 - protein, 785 aa, Artificial Sequence
  Rd1 MYCP combis
MHHHHHHGGSGMILDTDYITEDGKPIIRIFKKENGEFKIELDPHFQPYIYALLKDDSAIEEIKAITGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDGENPEPKIQRMGDSFAVEIKGRIHFDLFPVVRRTIRLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 77 - DNA, 2361 bp, Artificial Sequence
  Rd1 MYCP combis
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgagtgttgcgtatgcgcgtaacgagctggcgccgaacaaaccggatgaagaggaatacgaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgatgtggttgaaaaaatcgcgaagtaccgtgtgccgctggaaaagctggttattcacgagcaaatcacccgtgacctgaaagattataaggcgattggcccgcacgtgagcatcgcgaaacgtctggcggctcgtggtatcaaagtgaagccgggcaccatcattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 78 - protein, 785 aa, Artificial Sequence
  Rd1 MYCP combis
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLSVAYARNELAPNKPDEEEYERRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 79 - DNA, 2361 bp, Artificial Sequence
  Rd1 MYCP combis
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgatgtggttgaaaaaatcgcgaagtaccgtgtgccgctggaaaagctggttattcacgagcaaatcacccgtgacctgaaagattataaggcgattggcccgcacgtgagcatcgcgaaacgtctggcggctcgtggtatcaaagtgaagccgggcaccatcattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 80 - protein, 785 aa, Artificial Sequence
  Rd1 MYCP combis
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 81 - DNA, 2361 bp, Artificial Sequence
  Rd1 MYCP combis
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttatttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaacacggtagcgttgaaaaggcggtggagattgttcgtgacgtgactgaaaaactggcgaagtacgaggtgccgctggaaaagctggttattcacgagcaaatcacccgtgacctgaaagattataaggcgattggcccgcacgtgagcatcgcgaaacgtctggcggctcgtggtatcaaagtgaagccgggcaccgttattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 82 - protein, 785 aa, Artificial Sequence
  Rd1 MYCP combis
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKELFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKHGSVEKAVEIVRDVTEKLAKYEVPLEKLVIHEQITRDLKDYKAIGPHVSIAKRLAARGIKVKPGTVISYLVLKGSGKISDRVILLTEYDPEKHKYDPDYYIENQVLPAVLRILEAFGYRKEDLRYQSSKQTGLDTWLKR

SEQ ID NO: 83 - DNA, 2361 bp, Artificial Sequence
  Rd1 MYCP combis
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacggggaaaacccggagccgaagatccaacgtatgggtgatagcttcgcggtggagattaaaggccgtatccacttcgacctgtttccggtggttcgtcgtaccatcaagctgccgacctacaccctggaagcggtgtatgaggcggttctgggcaagaccaaaagcaagctgggcgcggaagagattgcggcgatctgggagaccgaagagagcatgaaaaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgctggagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgatgtggttgaaaaaatcgcgaagtaccgtgtgccgctggaaaagctggttattcacgagcaaatcacccgtgacctgaaagattataaggcgattggcccgcacgtgagcatcgcgaaacgtctggcgacccgtggtatcaaagtgaagccgggcaccatcattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 84 - protein, 785 aa, Artificial Sequence
  Rd1 MYCP combis
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDGENPEPKIQRMGDSFAVEIKGRIHFDLFPVVRRTIKLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKALEFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 85 - DNA, 2361 bp, Artificial Sequence
  Rd1 MYCP combis
atgcatcaccatcaccatcacggtggcagcggtatgattctggacaccgattacatcaccgaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgatgtggttgaaaaaatcgcgaagtaccgtgtgccgctggaaaagctggttattcacgagcaaatcacccgtgacctgaaagattataaggcgattggcccgcacgtgagcatcgcgaaacgtctggcgacccgtggtatcaaagtgaagccgggcaccatcattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 86 - protein, 785 aa, Artificial Sequence
  Rd1 MYCP combis
MHHHHHHGGSGMILDTDYITEDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 87 - DNA, 2361 bp, Artificial Sequence
  Rd1 MYCP combis
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtgactgaaaaactggcgaagtacgaggtgccgccggaaaagctggttattcacgagcaaatcacccgtgacctgaaagattataaggcgattggcccgcacgtgagcatcgcgaaacgtctggcgactcgtggtatcaaagtgaagccgggcaccattattagctacatcgttctgaaaggtagcggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 88 - protein, 785 aa, Artificial Sequence
  Rd1 MYCP combis
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVTEKLAKYEVPPEKLVIHEQITRDLKDYKAIGPHVSIAKRLATRGIKVKPGTIISYIVLKGSGKISDRVILLTEYDPEKHKYDPDYYIENQVLPAVLRILEAFGYRKEDLRYQSSKQTGLDTWLKR

SEQ ID NO: 89 - DNA, 2361 bp, Artificial Sequence
  Rd1 MCYP SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcctgaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgatgtggttgaaaaaatcgcgaagtaccgtgtgccgctggaaaagctggttattcacgagcaaatcacccgtgacctgaaagattataaggcgattggcccgcacgtgagcatcgcgaaacgtctggcgacccgtggtatcaaagtgaagccgggcaccatcattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 90 - protein, 785 aa, Artificial Sequence
  Rd1 MCYP SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEILKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 91 - DNA, 2361 bp, Artificial Sequence
  Rd1 MCYP SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaggctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgatgtggttgaaaaaatcgcgaagtaccgtgtgccgctggaaaagctggttattcacgagcaaatcacccgtgacctgaaagattataaggcgattggcccgcacgtgagcatcgcgaaacgtctggcgacccgtggtatcaaagtgaagccgggcaccatcattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 92 - protein, 785 aa, Artificial Sequence
  Rd1 MCYP SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTIRLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 93 - DNA, 2361 bp, Artificial Sequence
  Rd1 MCYP SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttgcgagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgatgtggttgaaaaaatcgcgaagtaccgtgtgccgctggaaaagctggttattcacgagcaaatcacccgtgacctgaaagattataaggcgattggcccgcacgtgagcatcgcgaaacgtctggcgacccgtggtatcaaagtgaagccgggcaccatcattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 94 - protein, 785 aa, Artificial Sequence
  Rd1 MCYP SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFASLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 95 - DNA, 2361 bp, Artificial Sequence
  Rd1 Fidelity SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgttggggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgatgtggttgaaaaaatcgcgaagtaccgtgtgccgctggaaaagctggttattcacgagcaaatcacccgtgacctgaaagattataaggcgattggcccgcacgtgagcatcgcgaaacgtctggcgacccgtggtatcaaagtgaagccgggcaccatcattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 96 - protein, 785 aa, Artificial Sequence
  Rd1 Fidelity SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRWGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 97 - DNA, 2361 bp, Artificial Sequence
  Rd1 MCYP SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatcgtaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgatgtggttgaaaaaatcgcgaagtaccgtgtgccgctggaaaagctggttattcacgagcaaatcacccgtgacctgaaagattataaggcgattggcccgcacgtgagcatcgcgaaacgtctggcgacccgtggtatcaaagtgaagccgggcaccatcattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 98 - protein, 785 aa, Artificial Sequence
  Rd1 MCYP SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYRKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 99 - DNA, 2361 bp, Artificial Sequence
  Rd1 MCYP SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcacctgtcgtggtctggaagtggttcgtcgtgactggagcgaaatcgcgaaagagacccaggcgaaggtgctggaagcgattctgaaagacggtagcgttgaaaaggcggtggagattgttcgtgatgtggttgaaaaaatcgcgaagtaccgtgtgccgctggaaaagctggttattcacgagcaaatcacccgtgacctgaaagattataaggcgattggcccgcacgtgagcatcgcgaaacgtctggcgacccgtggtatcaaagtgaagccgggcaccatcattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 100 - protein, 785 aa, Artificial Sequence
  Rd1 MCYP SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITCRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 101 - DNA, 2361 bp, Artificial Sequence
  Rd1 MCYP SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttcggaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgatgtggttgaaaaaatcgcgaagtaccgtgtgccgctggaaaagctggttattcacgagcaaatcacccgtgacctgaaagattataaggcgattggcccgcacgtgagcatcgcgaaacgtctggcgacccgtggtatcaaagtgaagccgggcaccatcattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 102 - protein, 785 aa, Artificial Sequence
  Rd1 MCYP SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFRTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 103 - DNA, 2361 bp, Artificial Sequence
  Rd1 MCYP SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacgcgcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgatgtggttgaaaaaatcgcgaagtaccgtgtgccgctggaaaagctggttattcacgagcaaatcacccgtgacctgaaagattataaggcgattggcccgcacgtgagcatcgcgaaacgtctggcgacccgtggtatcaaagtgaagccgggcaccatcattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 104 - protein, 785 aa, Artificial Sequence
  Rd1 MCYP SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYARRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 105 - DNA, 2361 bp, Artificial Sequence
  Rd1 MCYP SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgatgtggttgaaaaaatcgcgaagtactgtgtgccgctggaaaagctggttattcacgagcaaatcacccgtgacctgaaagattataaggcgattggcccgcacgtgagcatcgcgaaacgtctggcgacccgtggtatcaaagtgaagccgggcaccatcattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 106 - protein, 785 aa, Artificial Sequence
  Rd1 MCYP SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYCVPLEKLVIHEQITRDLKDYKAIGPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 107 - DNA, 2361 bp, Artificial Sequence
  Rd1 MCYP SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtggtcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgatgtggttgaaaaaatcgcgaagtaccgtgtgccgctggaaaagctggttattcacgagcaaatcacccgtgacctgaaagattataaggcgattggcccgcacgtgagcatcgcgaaacgtctggcgacccgtggtatcaaagtgaagccgggcaccatcattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 108 - protein, 785 aa, Artificial Sequence
  Rd1 MCYP SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRGRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 109 - DNA, 2361 bp, Artificial Sequence
  Rd1 MCYP SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgctcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacgggcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgatgtggttgaaaaaatcgcgaagtaccgtgtgccgctggaaaagctggttattcacgagcaaatcacccgtgacctgaaagattataaggcgattggcccgcacgtgagcatcgcgaaacgtctggcgacccgtggtatcaaagtgaagccgggcaccatcattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 110 - protein, 785 aa, Artificial Sequence
  Rd1 MCYP SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYGRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 111 - DNA, 2361 bp, Artificial Sequence
  Rd1 MCYP SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgatgtggttgaaaaaatcgcgaagtaccgtgtgccgctggaaaagctggttattcacgagcaaatcacccgtgacctgaaagattataaggcgattggcccgcacgtgagcatcgcgaaacgtctggcgacccgtggtatcaaagtgaagccgggcaccatcattagctacctggttctgaaaggtagcggcaagattagcgaccgtgttatcctgctgaccgaatacgatccggagaaacacaagtatgacccggattactatatcgagaaccaggtgctgccggcggttctgcgtattctgggggcgttcggttaccgtaaagaggacctgcgttatcagagcagcaagcaaaccggcctggatacctggctgaaacgttaatga

SEQ ID NO: 112 - protein, 785 aa, Artificial Sequence
  Rd1 MCYP SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGSGKISDRVILLTEYDPEKHKYDPDYYIENQVLPAVLRILGAFGYRKEDLRYQSSKQTGLDTWLKR

SEQ ID NO: 113 - DNA, 2361 bp, Artificial Sequence
  Rd1 MCYP SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgatgtggttgaaaaaatcgcgaagtaccgtgtgccgctggaaaagctggttattcacgagcaaatcacccgtgacctgaaagattataaggcgattggcccgcacgtgagcatcgcgaaacgtctggcgacccgtggtatcaaagtgaagccgggcaccatcattagctacctggttctgaaaggtagcggcaagattagcgaccgtgttatcctgctgaccgaatacgatccggagaaacacaagtatgacccggattactatatcgagaaccaggtgctgccggcggttctgcgtattctggaatggttcggttaccgtaaagaggacctgcgttatcagagcagcaagcaaaccggcctggatacctggctgaaacgttaatga

SEQ ID NO: 114 - protein, 785 aa, Artificial Sequence
  Rd1 MCYP SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGSGKISDRVILLTEYDPEKHKYDPDYYIENQVLPAVLRILEWFGYRKEDLRYQSSKQTGLDTWLKR

SEQ ID NO: 115 - DNA, 2361 bp, Artificial Sequence
  Rd1 MCYP SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgatgtggttgaaaaaatcgcgaagtaccgtgtgccgctggaaaagctggttattcacgagcaaatcacccgtgacctgaaagattataaggcgattggcccgcacgtgagcatcgcgaaacgtctggcgacccgtggtatcaaagtgaagccgggcaccatcattagctacctggttctgaaaggtagcggcaagattagcgaccgtgttatcctgctgaccgaatacgatccggaggtgcacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 116 - protein, 785 aa, Artificial Sequence
  Rd1 MCYP SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGSGKISDRVILLTEYDPEVHKYDPDYYIENQVLPAVLRILEAFGYRKEDLRYQSSKQTGLDTWLKR

SEQ ID NO: 117 - DNA, 2361 bp, Artificial Sequence
  Rd1 MCYP SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgtgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcacctttcgtggtctggaagtggttcgtcgtgactggagcgaaatcgcgaaagagacccaggcgaaggtgctggaagcgattctgaaagacggtagcgttgaaaaggcggtggagattgttcgtgatgtggttgaaaaaatcgcgaagtaccgtgtgccgctggaaaagctggttattcacgagcaaatcacccgtgacctgaaagattataaggcgattggcccgcacgtgagcatcgcgaaacgtctggcgacccgtggtatcaaagtgaagccgggcaccatcattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 118 - protein, 785 aa, Artificial Sequence
  Rd1 MCYP SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYVRNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITFRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 119 - DNA, 2361 bp, Artificial Sequence
  Rd1 MCYP SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcactcgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgcgggacggtagcgttgaaaaggcggtggagattgttcgtgatgtggttgaaaaaatcgcgaagtaccgtgtgccgctggaaaagctggttattcacgagcaaatcacccgtgacctgaaagattataaggcgattggcccgcacgtgagcatcgcgaaacgtctggcgacccgtggtatcaaagtgaagccgggcaccatcattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 120 - protein, 785 aa, Artificial Sequence
  Rd1 MCYP SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHSQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILRDGSVEKAVEIVRDVVEKIAKYRVPLEKLVIHEQITRDLKDYKAIGPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 121 - DNA, 2361 bp, Artificial Sequence
  Rd1 MCYP SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgcacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgatgtggttgaaaaaatcgcgaagtaccgtgtgccgctggaaaagctggttattcacgagcaaatcacccgtgacctgaaagattataaggcgattggcccgcacgtgagcatcgcgaaacgtctggcgacccgtggtatcaaagtgaagccgggcaccatcattagctacctggttctgaaaggtagcggcaagattagcgaccgtgttatcctgctgaccgaatacgatccggagaaacacaagtatgacccggattactatatcgagaaccaggtgctgccggcggttctgcgtattctgcatgcgttcggttaccgtaaagaggacctgcgttatcagagcagcaagcaaaccggcctggatacctggctgaaacgttaatga

SEQ ID NO: 122 - protein, 785 aa, Artificial Sequence
  Rd1 MCYP SNOCAPS
MHHHHHHGGSGMILDTDYITKDGKPIIRIFKKENGEFKIELDPHFQPHIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGSGKISDRVILLTEYDPEKHKYDPDYYIENQVLPAVLRILHAFGYRKEDLRYQSSKQTGLDTWLKR

SEQ ID NO: 123 - DNA, 2361 bp, Artificial Sequence
  Rd1 MCYP SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttattagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgatgtggttgaaaaaatcgcgaagtaccgtgtgccgctggaaaagctggttattcacgagcaaatcacccgtgacctgaaagattataaggcgattggcccgcacgtgagcatcgcgaaacgtctggcgacccgtggtatcaaagtgaagccgggcaccatcattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 124 - protein, 785 aa, Artificial Sequence
  Rd1 MCYP SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFISLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 125 - DNA, 2361 bp, Artificial Sequence
  Rd1 MCYP SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttgggagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgatgtggttgaaaaaatcgcgaagtaccgtgtgccgctggaaaagctggttattcacgagcaaatcacccgtgacctgaaagattataaggcgattggcccgcacgtgagcatcgcgaaacgtctggcgacccgtggtatcaaagtgaagccgggcaccatcattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 126 - protein, 785 aa, Artificial Sequence
  Rd1 MCYP SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFGSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 127 - DNA, 2361 bp, Artificial Sequence
  Rd1 MCYP SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgatgtggttgaaaaaatcgcgaagtaccgtgtgccgctggaaaagctggttattcacgagcaaatcacccgtgacctgaaagattataaggcgatttcgccgcacgtgagcatcgcgaaacgtctggcgacccgtggtatcaaagtgaagccgggcaccatcattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 128 - protein, 785 aa, Artificial Sequence
  Rd1 MCYP SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAISPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 129 - DNA, 2361 bp, Artificial Sequence
  Rd1 MCYP SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgtttgcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgatgtggttgaaaaaatcgcgaagtaccgtgtgccgctggaaaagctggttattcacgagcaaatcacccgtgacctgaaagattataaggcgattggcccgcacgtgagcatcgcgaaacgtctggcgacccgtggtatcaaagtgaagccgggcaccatcattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 130 - protein, 785 aa, Artificial Sequence
  Rd1 MCYP SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPFARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 131 - DNA, 2361 bp, Artificial Sequence
  Rd1 MCYP SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgtctgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgatgtggttgaaaaaatcgcgaagtaccgtgtgccgctggaaaagctggttattcacgagcaaatcacccgtgacctgaaagattataaggcgattggcccgcacgtgagcatcgcgaaacgtctggcgacccgtggtatcaaagtgaagccgggcaccatcattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 132 - protein, 785 aa, Artificial Sequence
  Rd1 MCYP SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVSAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 133 - DNA, 2361 bp, Artificial Sequence
  Rd1 MCYP SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccgtgcgtggtctggaagtggttcgtcgtgactggagcgaaatcgcgaaagagacccaggcgaaggtgctggaagcgattctgaaagacggtagcgttgaaaaggcggtggagattgttcgtgatgtggttgaaaaaatcgcgaagtaccgtgtgccgctggaaaagctggttattcacgagcaaatcacccgtgacctgaaagattataaggcgattggcccgcacgtgagcatcgcgaaacgtctggcgacccgtggtatcaaagtgaagccgggcaccatcattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 134 - protein, 785 aa, Artificial Sequence
  Rd1 MCYP SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITVRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 135 - DNA, 2361 bp, Artificial Sequence
  Rd1 MCYP SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgatgtggttgaaaaaatcgcgaagtaccgtgtgccgctggaaaagctggttattcacgagcaaatcacccgtgacctgaaagattataaggcgattggcccgcacgtgagcatcgcgaaacgtctggcgacccgtggtatcaaagtgaagccgggcaccatcattagctacctggttctgaaaggtagcggcaagattagcgaccgtgttatcctgctgaccgaatacgatccggagaaacacaagtatgacccggattactatatcgagaaccaggtgctgccggcggttctgcgtattctggaacgtttcggttaccgtaaagaggacctgcgttatcagagcagcaagcaaaccggcctggatacctggctgaaacgttaatga

SEQ ID NO: 136 - protein, 785 aa, Artificial Sequence
  Rd1 MCYP SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGSGKISDRVILLTEYDPEKHKYDPDYYIENQVLPAVLRILERFGYRKEDLRYQSSKQTGLDTWLKR

SEQ ID NO: 137 - DNA, 2361 bp, Artificial Sequence
  Rd1 MCYP SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgtgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgatgtggttgaaaaaatcgcgaagtaccgtgtgccgctggaaaagctggttattcacgagtctatcacccgtgacctgaaagattataaggcgattggcccgcacgtgagcatcgcgaaacgtctggcgacccgtggtatcaaagtgaagccgggcaccatcattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 138 - protein, 785 aa, Artificial Sequence
  Rd1 MCYP SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMCDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHESITRDLKDYKAIGPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 139 - DNA, 2361 bp, Artificial Sequence
  Rd1 MCYP SNOCAPS
atgcatcaccatcaccatcacggtggcagcggtatgattctggacaccgatcacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggattgtgaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgatgtggttgaaaaaatcgcgaagtaccgtgtgccgctggaaaagctggttattcacgagcaaatcacccgtgacctgaaagattataaggcgattggcccgcacgtgagcatcgcgaaacgtctggcgacccgtggtatcaaagtgaagccgggcaccatcattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 140 - protein, 785 aa, Artificial Sequence
  Rd1 MCYP SNOCAPS
MHHHHHHGGSGMILDTDHITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDCEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 141 - DNA, 2361 bp, Artificial Sequence
  Rd1 MCYP SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtcggagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgatgtggttgaaaaaatcgcgaagtaccgtgtgccgctggaaaagctggttattcacgagcaaatcacccgtgacctgaaagattataaggcgattggcccgcacgtgagcatcgcgaaacgtctggcgacccgtggtatcaaagtgaagccgggcaccatcattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 142 - protein, 785 aa, Artificial Sequence
  Rd1 MCYP SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRRSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 143 - DNA, 2361 bp, Artificial Sequence
  Rd1 MCYP SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaaggtaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgatgtggttgaaaaaatcgcgaagtaccgtgtgccgctggaaaagctggttattcacgagcaaatcacccgtgacctgaaagattataaggcgattggcccgcacgtgagcatcgcgaaacgtctggcgacccgtggtatcaaagtgaagccgggcaccatcattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 144 - protein, 785 aa, Artificial Sequence
  Rd1 MCYP SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEGKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 145 - DNA, 2361 bp, Artificial Sequence
  Rd1 MCYP SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtcggggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgatgtggttgaaaaaatcgcgaagtaccgtgtgccgctggaaaagctggttattcacgagcaaatcacccgtgacctgaaagattataaggcgattggcccgcacgtgagcatcgcgaaacgtctggcgacccgtggtatcaaagtgaagccgggcaccatcattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 146 - protein, 785 aa, Artificial Sequence
  Rd1 MCYP SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRRGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 147 - DNA, 2361 bp, Artificial Sequence
  Rd1 MCYP SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtcagctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgatgtggttgaaaaaatcgcgaagtaccgtgtgccgctggaaaagctggttattcacgagcaaatcacccgtgacctgaaagattataaggcgattggcccgcacgtgagcatcgcgaaacgtctggcgacccgtggtatcaaagtgaagccgggcaccatcattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 148 - protein, 785 aa, Artificial Sequence
  Rd1 MCYP SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRQLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 149 - DNA, 2361 bp, Artificial Sequence
  Rd1 MCYP SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttgttagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgatgtggttgaaaaaatcgcgaagtaccgtgtgccgctggaaaagctggttattcacgagcaaatcacccgtgacctgaaagattataaggcgattggcccgcacgtgagcatcgcgaaacgtctggcgacccgtggtatcaaagtgaagccgggcaccatcattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 150 - protein, 785 aa, Artificial Sequence
  Rd1 MCYP SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFVSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 151 - DNA, 2361 bp, Artificial Sequence
  Rd1 MCYP SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttaagagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgatgtggttgaaaaaatcgcgaagtaccgtgtgccgctggaaaagctggttattcacgagcaaatcacccgtgacctgaaagattataaggcgattggcccgcacgtgagcatcgcgaaacgtctggcgacccgtggtatcaaagtgaagccgggcaccatcattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 152 - protein, 785 aa, Artificial Sequence
  Rd1 MCYP SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFKSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 153 - DNA, 2361 bp, Artificial Sequence
  Rd1 MCYP SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcggtaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgatgtggttgaaaaaatcgcgaagtaccgtgtgccgctggaaaagctggttattcacgagcaaatcacccgtgacctgaaagattataaggcgattggcccgcacgtgagcatcgcgaaacgtctggcgacccgtggtatcaaagtgaagccgggcaccatcattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 154 - protein, 785 aa, Artificial Sequence
  Rd1 MCYP SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSGTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 155 - DNA, 2361 bp, Artificial Sequence
  Rd1 MCYP SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagctggaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgatgtggttgaaaaaatcgcgaagtaccgtgtgccgctggaaaagctggttattcacgagcaaatcacccgtgacctgaaagattataaggcgattggcccgcacgtgagcatcgcgaaacgtctggcgacccgtggtatcaaagtgaagccgggcaccatcattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 156 - protein, 785 aa, Artificial Sequence
  Rd1 MCYP SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSWTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 157 - DNA, 2361 bp, Artificial Sequence
  Rd1 MCYP SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgcgggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgatgtggttgaaaaaatcgcgaagtaccgtgtgccgctggaaaagctggttattcacgagcaaatcacccgtgacctgaaagattataaggcgattggcccgcacgtgagcatcgcgaaacgtctggcgacccgtggtatcaaagtgaagccgggcaccatcattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 158 - protein, 785 aa, Artificial Sequence
  Rd1 MCYP SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPRARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 159 - DNA, 2361 bp, Artificial Sequence
  Rd1 MCYP SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcactgaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgatgtggttgaaaaaatcgcgaagtaccgtgtgccgctggaaaagctggttattcacgagcaaatcacccgtgacctgaaagattataaggcgattggcccgcacgtgagcatcgcgaaacgtctggcgacccgtggtatcaaagtgaagccgggcaccatcattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 160 - protein, 785 aa, Artificial Sequence
  Rd1 MCYP SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSTECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 161 - DNA, 2361 bp, Artificial Sequence
  Rd1 MCYP SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgggggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgatgtggttgaaaaaatcgcgaagtaccgtgtgccgctggaaaagctggttattcacgagcaaatcacccgtgacctgaaagattataaggcgattggcccgcacgtgagcatcgcgaaacgtctggcgacccgtggtatcaaagtgaagccgggcaccatcattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 162 - protein, 785 aa, Artificial Sequence
  Rd1 MCYP SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPGARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 163 - DNA, 2361 bp, Artificial Sequence
  Rd1 MCYP SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtggcggcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgatgtggttgaaaaaatcgcgaagtaccgtgtgccgctggaaaagctggttattcacgagcaaatcacccgtgacctgaaagattataaggcgattggcccgcacgtgagcatcgcgaaacgtctggcgacccgtggtatcaaagtgaagccgggcaccatcattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 164 - protein, 785 aa, Artificial Sequence
  Rd1 MCYP SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVAAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 165 - DNA, 2361 bp, Artificial Sequence
  Rd1 MCYP SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgatgtggttgaaaaaatcgcgacttaccgtgtgccgctggaaaagctggttattcacgagcaaatcacccgtgacctgaaagattataaggcgattggcccgcacgtgagcatcgcgaaacgtctggcgacccgtggtatcaaagtgaagccgggcaccatcattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 166 - protein, 785 aa, Artificial Sequence
  Rd1 MCYP SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIATYRVPLEKLVIHEQITRDLKDYKAIGPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 167 - DNA, 2361 bp, Artificial Sequence
  Rd1 MCYP SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgatgtggtttgtaaaatcgcgaagtaccgtgtgccgctggaaaagctggttattcacgagcaaatcacccgtgacctgaaagattataaggcgattggcccgcacgtgagcatcgcgaaacgtctggcgacccgtggtatcaaagtgaagccgggcaccatcattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 168 - protein, 785 aa, Artificial Sequence
  Rd1 MCYP SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVCKIAKYRVPLEKLVIHEQITRDLKDYKAIGPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 169 - DNA, 2361 bp, Artificial Sequence
  Rd1 MCYP SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgatgtggttgaaaaaatcgcgaagtaccgtgtgccgctggaaaagctggttattcacgagcaaatcacccgtgacctgaaagattataaggcgattggcccgcacgtgagcatcgcgaaacgtctggcgacccgtggtatcaaagtgaagccgggcaccatcattagctacctggttctgaaaggtagcggcaagattagcgaccgtgttatcctgctgaccgaatacgatccggagaaacacaagtatgacccggattactatatcgagaaccaggtgctgccgtgtgttctgcgtattctggaagcgttcggttaccgtaaagaggacctgcgttatcagagcagcaagcaaaccggcctggatacctggctgaaacgttaatga

SEQ ID NO: 170 - protein, 785 aa, Artificial Sequence
  Rd1 MCYP SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGSGKISDRVILLTEYDPEKHKYDPDYYIENQVLPCVLRILEAFGYRKEDLRYQSSKQTGLDTWLKR

SEQ ID NO: 171 - DNA, 2361 bp, Artificial Sequence
  Rd1 MCYP SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcggtatcgcgaaagagacccaggcgaaggtgctggaagcgattctgaaagacggtagcgttgaaaaggcggtggagattgttcgtgatgtggttgaaaaaatcgcgaagtaccgtgtgccgctggaaaagctggttattcacgagcaaatcacccgtgacctgaaagattataaggcgattggcccgcacgtgagcatcgcgaaacgtctggcgacccgtggtatcaaagtgaagccgggcaccatcattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 172 - protein, 785 aa, Artificial Sequence
  Rd1 MCYP SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSGIAKETQAKVLEAILKDGSVEKAVEIVRDVVEKIAKYRVPLEKLVIHEQITRDLKDYKAIGPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 173 - DNA, 2361 bp, Artificial Sequence
  Rd1 MCYP SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgatgtggttgaaaaaatcgcgaagtaccgtgtgccgctggaaaagctggttattcacgagcaaatcacccgtgacctggatgattataaggcgattggcccgcacgtgagcatcgcgaaacgtctggcgacccgtggtatcaaagtgaagccgggcaccatcattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 174 - protein, 785 aa, Artificial Sequence
  Rd1 MCYP SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAIGPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 175 - DNA, 2361 bp, Artificial Sequence
  Rd1 MCYP SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgatgtggttgaaaaaatcgcgaagtaccgtgtgccgctggaaaagctggttattcacgagcaaatcacccgtgacctgaaagattataaggcgattggcccgcacgtgagcatcgcgaaacgtctggcgacccgtggtatcaaagtgaagccgggcaccatcattagctacctggttctgaaaggtcgtggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 176 - protein, 785 aa, Artificial Sequence
  Rd1 MCYP SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGRGKISDRVILLTEYDPEKHKYDPDYYIENQVLPAVLRILEAFGYRKEDLRYQSSKQTGLDTWLKR

SEQ ID NO: 177 - DNA, 2361 bp, Artificial Sequence
  Rd1 MCYP SNOCAPS
atgcatcaccatcaccatcacggtggcagcggtatgattctggacaccgattacatcaccaaagatggcaagccgatcattcgtattttcaagaaagaaaacggcgagtttaagatcgagctggacctgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgagtgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgatgtggttgaaaaaatcgcgaagtaccgtgtgccgctggaaaagctggttattcacgagcaaatcacccgtgacctgaaagattataaggcgattggcccgcacgtgagcatcgcgaaacgtctggcgacccgtggtatcaaagtgaagccgggcaccatcattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 178 - protein, 785 aa, Artificial Sequence
  Rd1 MCYP SNOCAPS
MHHHHHHGGSGMILDTDYITKDGKPIIRIFKKENGEFKIELDLHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVSAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 179 - DNA, 2361 bp, Artificial Sequence
  Rd1 MCYP SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtatgcgtaccacctaccggggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgatgtggttgaaaaaatcgcgaagtaccgtgtgccgctggaaaagctggttattcacgagcaaatcacccgtgacctgaaagattataaggcgattggcccgcacgtgagcatcgcgaaacgtctggcgacccgtggtatcaaagtgaagccgggcaccatcattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 180 - protein, 785 aa, Artificial Sequence
  Rd1 MCYP SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRMRTTYRGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 181 - DNA, 2361 bp, Artificial Sequence
  Rd1 MCYP SNOCAPS
atgcatcaccatcaccatcacggtggcagcggtatgattctggacaccgattacatcaccaaagatggcatgccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgatgtggttgaaaaaatcgcgaagtaccgtgtgccgctggaaaagctggttattcacgagcaaatcacccgtgacctgaaagattataaggcgattggcccgcacgtgagcatcgcgaaacgtctggcgacccgtggtatcaaagtgaagccgggcaccatcattagctacctggttctggctggtagcggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 182 - protein, 785 aa, Artificial Sequence
  Rd1 MCYP SNOCAPS
MHHHHHHGGSGMILDTDYITKDGMPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLAGSGKISDRVILLTEYDPEKHKYDPDYYIENQVLPAVLRILEAFGYRKEDLRYQSSKQTGLDTWLKR

SEQ ID NO: 183 - DNA, 2361 bp, Artificial Sequence
  Rd1 MCYP SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacaacaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgatgtggttgaaaaaatcgcgaagtaccgtgtgccgctggaaaagctggttattcacgagcaaatcacccgtgacctgaaagattataaggcgattggcccgcacgtgagcatcgcgaaacgtctggcgacccgtggtatcaaagtgaagccgggcaccatcattagctacctggttctgaaaggtagcggcaagattagcgaccgtgttatcgctctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 184 - protein, 785 aa, Artificial Sequence
  Rd1 MCYP SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINNKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGSGKISDRVIALTEYDPEKHKYDPDYYIENQVLPAVLRILEAFGYRKEDLRYQSSKQTGLDTWLKR

SEQ ID NO: 185 - DNA, 2361 bp, Artificial Sequence
  Rd1 MCYP SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaaccggtactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgatgtggttgaaaaaatcgcgaagtaccgtgtgccgctggaaaagctggttattcacgagcaaatcacccgtgacctgaaagattataaggcgattggcccgcacgtgagcatcgcgaaacgtctggcgacccgtggtatcaaagtgaagccgggcaccatcattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 186 - protein, 785 aa, Artificial Sequence
  Rd1 MCYP SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANRYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 187 - DNA, 2361 bp, Artificial Sequence
  Rd1 MCYP SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagctgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgatgtggttgaaaaaatcgcgaagtaccgtgtgccgctggaaaagctggttattcacgagcaaatcacccgtgacctgaaagattataaggcgattggcccgcacgtgagcatcgcgaaacgtctggcgacccgtggtatcaaagtgaagccgggcaccatcattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 188 - protein, 785 aa, Artificial Sequence
  Rd1 MCYP SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSCSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 189 - DNA, 2361 bp, Artificial Sequence
  Rd1 MCYP SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaagcgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgatgtggttgaaaaaatcgcgaagtaccgtgtgccgctggaaaagctggttattcacgagcaaatcacccgtgacctgaaagattataaggcgattggcccgcacgtgagcatcgcgaaacgtctggcgacccgtggtatcaaagtgaagccgggcaccatcattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 190 - protein, 785 aa, Artificial Sequence
  Rd1 MCYP SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKALANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 191 - DNA, 2361 bp, Artificial Sequence
  Rd1 MCYP SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtatgctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgatgtggttgaaaaaatcgcgaagtaccgtgtgccgctggaaaagctggttattcacgagcaaatcacccgtgacctgaaagattataaggcgattggcccgcacgtgagcatcgcgaaacgtctggcgacccgtggtatcaaagtgaagccgggcaccatcattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 192 - protein, 785 aa, Artificial Sequence
  Rd1 MCYP SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRMLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 193 - DNA, 2361 bp, Artificial Sequence
  Rd1 MCYP SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaacagaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgatgtggttgaaaaaatcgcgaagtaccgtgtgccgctggaaaagctggttattcacgagcaaatcacccgtgacctgaaagattataaggcgattggcccgcacgtgagcatcgcgaaacgtctggcgacccgtggtatcaaagtgaagccgggcaccatcattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 194 - protein, 785 aa, Artificial Sequence
  Rd1 MCYP SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEQKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 195 - DNA, 2361 bp, Artificial Sequence
  Rd1 MCYP SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaagctaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgatgtggttgaaaaaatcgcgaagtaccgtgtgccgctggaaaagctggttattcacgagcaaatcacccgtgacctgaaagattataaggcgattggcccgcacgtgagcatcgcgaaacgtctggcgacccgtggtatcaaagtgaagccgggcaccatcattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 196 - protein, 785 aa, Artificial Sequence
  Rd1 MCYP SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEAKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 197 - DNA, 2361 bp, Artificial Sequence
  Rd1 MCYP SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtgttagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgatgtggttgaaaaaatcgcgaagtaccgtgtgccgctggaaaagctggttattcacgagcaaatcacccgtgacctgaaagattataaggcgattggcccgcacgtgagcatcgcgaaacgtctggcgacccgtggtatcaaagtgaagccgggcaccatcattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 198 - protein, 785 aa, Artificial Sequence
  Rd1 MCYP SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRVSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 199 - DNA, 2361 bp, Artificial Sequence
  Rd1 MCYP SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtacgagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgatgtggttgaaaaaatcgcgaagtaccgtgtgccgctggaaaagctggttattcacgagcaaatcacccgtgacctgaaagattataaggcgattggcccgcacgtgagcatcgcgaaacgtctggcgacccgtggtatcaaagtgaagccgggcaccatcattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 200 - protein, 785 aa, Artificial Sequence
  Rd1 MCYP SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRTSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 201 - DNA, 2361 bp, Artificial Sequence
  Rd1 MCYP SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcatgaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgatgtggttgaaaaaatcgcgaagtaccgtgtgccgctggaaaagctggttattcacgagcaaatcacccgtgacctgaaagattataaggcgattggcccgcacgtgagcatcgcgaaacgtctggcgacccgtggtatcaaagtgaagccgggcaccatcattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 202 - protein, 785 aa, Artificial Sequence
  Rd1 MCYP SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSMTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 203 - DNA, 2361 bp, Artificial Sequence
  Rd1 MCYP SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagccggggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgatgtggttgaaaaaatcgcgaagtaccgtgtgccgctggaaaagctggttattcacgagcaaatcacccgtgacctgaaagattataaggcgattggcccgcacgtgagcatcgcgaaacgtctggcgacccgtggtatcaaagtgaagccgggcaccatcattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 204 - protein, 785 aa, Artificial Sequence
  Rd1 MCYP SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSRGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 205 - DNA, 2361 bp, Artificial Sequence
  Rd1 MCYP SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagccctgaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgatgtggttgaaaaaatcgcgaagtaccgtgtgccgctggaaaagctggttattcacgagcaaatcacccgtgacctgaaagattataaggcgattggcccgcacgtgagcatcgcgaaacgtctggcgacccgtggtatcaaagtgaagccgggcaccatcattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 206 - protein, 785 aa, Artificial Sequence
  Rd1 MCYP SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSPECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 207 - DNA, 2361 bp, Artificial Sequence
  Rd1 MCYP SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtacgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgatgtggttgaaaaaatcgcgaagtaccgtgtgccgctggaaaagctggttattcacgagcaaatcacccgtgacctgaaagattataaggcgattggcccgcacgtgagcatcgcgaaacgtctggcgacccgtggtatcaaagtgaagccgggcaccatcattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 208 - protein, 785 aa, Artificial Sequence
  Rd1 MCYP SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRTRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 209 - DNA, 2361 bp, Artificial Sequence
  Rd1 MCYP SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcaacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgatgtggttgaaaaaatcgcgaagtaccgtgtgccgctggaaaagctggttattcacgagcaaatcacccgtgacctgaaagattataaggcgattggcccgcacgtgagcatcgcgaaacgtctggcgacccgtggtatcaaagtgaagccgggcaccatcattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 210 - protein, 785 aa, Artificial Sequence
  Rd1 MCYP SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGNNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 211 - DNA, 2361 bp, Artificial Sequence
  Rd1 MCYP SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtaatcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgatgtggttgaaaaaatcgcgaagtaccgtgtgccgctggaaaagctggttattcacgagcaaatcacccgtgacctgaaagattataaggcgattggcccgcacgtgagcatcgcgaaacgtctggcgacccgtggtatcaaagtgaagccgggcaccatcattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 212 - protein, 785 aa, Artificial Sequence
  Rd1 MCYP SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRNRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 213 - DNA, 2361 bp, Artificial Sequence
  Rd1 MCYP SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgatgtggttgaaaaaatcgcgaagtacttggtgccgctggaaaagctggttattcacgagcaaatcacccgtgacctgaaagattataaggcgattggcccgcacgtgagcatcgcgaaacgtctggcgacccgtggtatcaaagtgaagccgggcaccatcattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 214 - protein, 785 aa, Artificial Sequence
  Rd1 MCYP SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYLVPLEKLVIHEQITRDLKDYKAIGPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 215 - DNA, 2361 bp, Artificial Sequence
  Rd1 MCYP SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtgtggattgttcgtgatgtggttgaaaaaatcgcgaagtaccgtgtgccgctggaaaagctggttattcacgagcaaatcacccgtgacctgaaagattataaggcgattggcccgcacgtgagcatcgcgaaacgtctggcgacccgtggtatcaaagtgaagccgggcaccatcattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 216 - protein, 785 aa, Artificial Sequence
  Rd1 MCYP SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVWIVRDVVEKIAKYRVPLEKLVIHEQITRDLKDYKAIGPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 217 - DNA, 2361 bp, Artificial Sequence
  Rd1 MCYP SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgagggacggtagcgttgaaaaggcggtggagattgttcgtgatgtggttgaaaaaatcgcgaagtaccgtgtgccgctggaaaagctggttattcacgagcaaatcacccgtgacctgaaagattataaggcgattggcccgcacgtgagcatcgcgaaacgtctggcgacccgtggtatcaaagtgaagccgggcaccatcattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 218 - protein, 785 aa, Artificial Sequence
  Rd1 MCYP SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILRDGSVEKAVEIVRDVVEKIAKYRVPLEKLVIHEQITRDLKDYKAIGPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 219 - DNA, 2361 bp, Artificial Sequence
  Rd1 MCYP SNOCAPS
atgcatcaccatcaccatcacggtggcagcggtatgattctggacaccgattacatcaccaaagatggcaagccgatcattcgtattttcaagaaagaaaacggagagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgatgtggttgaaaaaatcgcgaagtaccgtgtgccgctggaaaagctggttattcacgagcaaatcacccgtgacctgaaagattataaggcgattggcccgcacgtgagcatcgcgaaacgtctggcggctcgtggtatcaaagtgaagccgggcaccatcattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 220 - protein, 785 aa, Artificial Sequence; identical to SEQ ID NO: 80
  Rd1 MCYP SNOCAPS

SEQ ID NO: 221 - DNA, 2361 bp, Artificial Sequence
  Rd1 MCYP SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgatgtggttgaaaaaatcgcgaagtaccgtgtgccgctggaaaagctggttattcacgagcaaatcacccgtgacctgaaagattataaggcgattggcccgcacgtgagcatcgcgaaacgtctggcgacccgtggtatcaaagtgaagccgggcaccatcattagctacctggttctgaaaggtacgggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 222 - protein, 785 aa, Artificial Sequence
  Rd1 MCYP SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGTGKISDRVILLTEYDPEKHKYDPDYYIENQVLPAVLRILEAFGYRKEDLRYQSSKQTGLDTWLKR

SEQ ID NO: 223 - DNA, 2361 bp, Artificial Sequence
  Rd1 MCYP SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaaaatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgatgtggttgaaaaaatcgcgaagtaccgtgtgccgctggaaaagctggttattcacgagcaaatcacccgtgacctgaaagattataaggcgattggcccgcacgtgagcatcgcgaaacgtctggcgacccgtggtatcaaagtgaagccgggcaccatcattagctacctggttctgaaaggtagcggcaagattagcgaccgtgttatcctgctgaccgaatacgatccggagaaacacaagtatgacccggattactatatcgagaaccaggtgctgccggcggttctgcgtattctgtttgcgttcggttaccgtaaagaggacctgcgttatcagagcagcaagcaaaccggcctggatacctggctgaaacgttaatga

SEQ ID NO: 224 - protein, 785 aa, Artificial Sequence
  Rd1 MCYP SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGSGKISDRVILLTEYDPEKHKYDPDYYIENQVLPAVLRILFAFGYRKEDLRYQSSKQTGLDTWLKR

SEQ ID NO: 225 - DNA, 2361 bp, Artificial Sequence
  Rd 2 MCYP combis
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaaattctggcgaacagcttttatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgctatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctgaaagattataaggcgattggcccgcacgtggcgatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacgcggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 226 - protein, 785 aa, Artificial Sequence
  Rd 2 MCYP combis
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKILANSFYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLKDYKAIGPHVAIAKRLAARGIKVKPGTIISYLVLKGSGKISDRVILLTEYDPEKHKYDADYYIENQVLPAVLRILEAFGYRKEDLRYQSSKQTGLDTWLKR

SEQ ID NO: 227 - DNA, 2361 bp, Artificial Sequence
  Rd 2 MCYP combis
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcgggaccggcaacctggtggaatggtacctgctgcgtgttgcgtatgcgcgtaacgagctggcgccgaacaaaccggatgaagaggaatacaagcgtcgtacccgtaccacctacctgggtggctatgtgaaagagccggaaaagggtctgtgggagaacatcatttacctggactttgctagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgtcggcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgcgcgacggtagcgttgaaaaggcggtggagattgttcgtgaggtggtcgaaaaaatcgcgacgtaccgtgtgccgctggaaaagctggttattcacgagcaaatcacccgtgacctgaaagattataaggcgattggcccgcacgtgagcatcgcgaaacgtctggcggctcgtggtatcaaagtgaagccgggcaccattattagctacctggttctgaaaggtacgggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 228 - protein, 785 aa, Artificial Sequence
  Rd 2 MCYP combis
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSGTGNLVEWYLLRVAYARNELAPNKPDEEEYKRRTRTTYLGGYVKEPEKGLWENIIYLDFASLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVSAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILRDGSVEKAVEIVREVVEKIATYRVPLEKLVIHEQITRDLKDYKAIGPHVSIAKRLAARGIKVKPGTIISYLVLKGTGKISDRVILLTEYDPEKHKYDPDYYIENQVLPAVLRILEAFGYRKEDLRYQSSKQTGLDTWLKR

SEQ ID NO: 229 - DNA, 2361 bp, Artificial Sequence
  Rd2 Fidelity SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagctcgaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgtcggcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgcgcgacggtagcgttgaaaaggcggtggagattgttcgtgatgtggtcgaaaaaatcgcgaagtacctggtgccgctggaaaagctggttattcacgagcaaatcacccgtgacctgaaagattataaggcgattggcccgcacgtgagcatcgcgaaacgtctggcggcgcgtggtatcaaagtgaagccgggcaccattattagctacctggttctgaaaggttcgggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 230 - protein, 785 aa, Artificial Sequence
  Rd2 Fidelity SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVSAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILRDGSVEKAVEIVRDVVEKIAKYLVPLEKLVIHEQITRDLKDYKAIGPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 231 - DNA, 2361 bp, Artificial Sequence
  Rd 2 MCYP combis
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcgggaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtggcggcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgcgcgacggtagcgttgaaaaggcggtggagattgttcgtgaggtggtcgaaaaaatcgcgacgtaccgtgtgccgctggaaaagctggttattcacgagcaaatcacccgtgacctgaaagattataaggcgattggcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacgcggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 232 - protein, 785 aa, Artificial Sequence
  Rd 2 MCYP combis
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSGTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVAAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILRDGSVEKAVEIVREVVEKIATYRVPLEKLVIHEQITRDLKDYKAIGPHVSIAKRLAARGIKVKPGTIISYLVLKGSGKISDRVILLTEYDPEKHKYDADYYIENQVLPAVLRILEAFGYRKEDLRYQSSKQTGLDTWLKR

SEQ ID NO: 233 - DNA, 2361 bp, Artificial Sequence
  Rd 2 MCYP combis
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtggccgtaccacctacctgggtggctatgtgaaagagccggaaaagggtctgtgggagaacatcatttacctggactttaagagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagttactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctgaaagattataaggcgattggcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacgcggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 234 - protein, 785 aa, Artificial Sequence
  Rd 2 MCYP combis
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRGRTTYLGGYVKEPEKGLWENIIYLDFKSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLKDYKAIGPHVSIAKRLAARGIKVKPGTIISYLVLKGSGKISDRVILLTEYDPEKHKYDADYYIENQVLPAVLRILEAFGYRKEDLRYQSSKQTGLDTWLKR

SEQ ID NO: 235 - DNA, 2361 bp, Artificial Sequence
  Rd 2 MCYP combis
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcgggaccggcaacctggtggaatggtacctgctgcgtgttgcgtatgcgcgtaacgagctggcgccgaacaaaccggatgaagaggaatacaagcgtcgtacccgtaccacctacctgggtggctatgtgaaagagccggaaaagggtctgtgggagaacatcatttacctggactttgctagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtggcggcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgacgtaccgtgtgccgctggaaaagctggttattcacgagcaaatcacccgtgacctgaaagattataaggcgattggcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacgcggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 236 - protein, 785 aa, Artificial Sequence
  Rd 2 MCYP combis
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSGTGNLVEWYLLRVAYARNELAPNKPDEEEYKRRTRTTYLGGYVKEPEKGLWENIIYLDFASLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVAAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIATYRVPLEKLVIHEQITRDLKDYKAIGPHVSIAKRLAARGIKVKPGTIISYLVLKGSGKISDRVILLTEYDPEKHKYDADYYIENQVLPAVLRILEAFGYRKEDLRYQSSKQTGLDTWLKR

SEQ ID NO: 237 - DNA, 2361 bp, Artificial Sequence
  Rd 2 MCYP combis
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagctcgaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgtcggcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtacctggtgccgctggaaaagctggttattcacgagcaaatcacccgtgacctgaaagattataaggcgattggcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacgcggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 238 - protein, 785 aa, Artificial Sequence
  Rd 2 MCYP combis
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVSAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYLVPLEKLVIHEQITRDLKDYKAIGPHVSIAKRLAARGIKVKPGTIISYLVLKGSGKISDRVILLTEYDPEKHKYDADYYIENQVLPAVLRILEAFGYRKEDLRYQSSKQTGLDTWLKR

SEQ ID NO: 239 - DNA, 2355 bp, Artificial Sequence; identical to SEQ ID NO: 23
  Rd 2 MCYP combis

SEQ ID NO: 240 - protein, 785 aa, Artificial Sequence; identical to SEQ ID NO: 24
  Rd 2 MCYP combis

SEQ ID NO: 241 - DNA, 2361 bp, Artificial Sequence
  Rd 2 MCYP combis
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgacgtaccgtgtgccgctggaaaagctggttattcacgagcaaatcacccgtgacctgaaagattataaggcgattggcccgcacgtgagcatcgcgaaacgtctggcggcgcgtggtatcaaagtgaagccgggcaccattattagctacctggttctgaaaggtagcggcaagattagcgaccgtgttatcctgctgaccgaatacgatccggagaaacacaagtatgacgcggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 242 - protein, 785 aa, Artificial Sequence
  Rd 2 MCYP combis
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIATYRVPLEKLVIHEQITRDLKDYKAIGPHVSIAKRLAARGIKVKPGTIISYLVLKGSGKISDRVILLTEYDPEKHKYDADYYIENQVLPAVLRILEAFGYRKEDLRYQSSKQTGLDTWLKR

SEQ ID NO: 243 - DNA, 2361 bp, Artificial Sequence
  Rd 2 MCYP combis
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcgggaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgtcggcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgcgcgacggtagcgttgaaaaggcggtggagattgttcgtgaggtggtcgaaaaaatcgcgaagtaccgtgtgccgctggaaaagctggttattcacgagcaaatcacccgtgacctgaaagattataaggcgattggcccgcacgtgagcatcgcgaaacgtctggcgacgcgtggtatcaaagtgaagccgggcaccattattagctacctggttctgaaaggtacgggcaagattagcgaccgtgttatcctgctgaccgaatacgatccggagaaacacaagtatgacgcggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 244 - protein, 785 aa, Artificial Sequence
  Rd 2 MCYP combis
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSGTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVSAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILRDGSVEKAVEIVREVVEKIAKYRVPLEKLVIHEQITRDLKDYKAIGPHVSIAKRLATRGIKVKPGTIISYLVLKGTGKISDRVILLTEYDPEKHKYDADYYIENQVLPAVLRILEAFGYRKEDLRYQSSKQTGLDTWLKR

SEQ ID NO: 245 - DNA, 2361 bp, Artificial Sequence
  Rd 2 MCYP combis
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgtcggcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctgaaagattataaggcgattggcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 246 - protein, 785 aa, Artificial Sequence
  Rd 2 MCYP combis
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVSAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLKDYKAIGPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 247 - DNA, 2361 bp, Artificial Sequence
  Rd 2 MCYP combis
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagctggaccggcaacctggtggaatggtacctgctgcgtgttgcgtatgcgcgtaacgagctggcgccgaacaaaccggatgaagaggaatacaagcgtcgtacccgtaccacctacctgggtggctatgtgaaagagccggaaaagggtctgtgggagaacatcatttacctggactttgctagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgcgcgacggtagcgttgaaaaggcggtggagattgttcgtgaggtggtcgaaaaaatcgcgacgtaccgtgtgccgctggaaaagctggttattcacgagcaaatcacccgtgacctgaaagattataaggcgattggcccgcacgtgagcatcgcgaaacgtctggcgacgcgtggtatcaaagtgaagccgggcaccattattagctacctggttctgaaaggtacgggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 248 - protein, 785 aa, Artificial Sequence
  Rd 2 MCYP combis
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSWTGNLVEWYLLRVAYARNELAPNKPDEEEYKRRTRTTYLGGYVKEPEKGLWENIIYLDFASLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILRDGSVEKAVEIVREVVEKIATYRVPLEKLVIHEQITRDLKDYKAIGPHVSIAKRLATRGIKVKPGTIISYLVLKGTGKISDRVILLTEYDPEKHKYDPDYYIENQVLPAVLRILEAFGYRKEDLRYQSSKQTGLDTWLKR

SEQ ID NO: 249 - DNA, 2361 bp, Artificial Sequence
  Rd 2 MCYP combis
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcgggaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtggcggcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgacgtaccgtgtgccgctggaaaagctggttattcacgagcaaatcacccgtgacctgaaagattataaggcgattggcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacgcggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 250 - protein, 785 aa, Artificial Sequence
  Rd 2 MCYP combis
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSGTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVAAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIATYRVPLEKLVIHEQITRDLKDYKAIGPHVSIAKRLAARGIKVKPGTIISYLVLKGSGKISDRVILLTEYDPEKHKYDADYYIENQVLPAVLRILEAFGYRKEDLRYQSSKQTGLDTWLKR

SEQ ID NO: 251 - DNA, 2361 bp, Artificial Sequence
  Rd 2 MCYP combis
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgataacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagtatgaccggcaacctggtggaatggtacctgctgcgtgttgcgtatgcgcgtaacgagctggcgccgaacaaaccggatgaagaggaatacgctcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctgaaagattataaggcgattggcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacgcagattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 252 - protein, 785 aa, Artificial Sequence
  Rd 2 MCYP combis
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSMTGNLVEWYLLRVAYARNELAPNKPDEEEYARRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLAARGIKVKPGTIISYLVLKGSGKISDRVILLTEYDPEKHKYDADYYIENQVLPAVLRILEAFGYRKEDLRYQSSKQTGLDTWLKR

SEQ ID NO: 253 - DNA, 2361 bp, Artificial Sequence
  Rd 2 MCYP combis
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaatctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcacctgccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctgaaagattataaggcgattggcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacgcggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 254 - protein, 785 aa, Artificial Sequence
  Rd 2 MCYP combis
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITCRGLEVVRRDWSEIAKETQAKVLEAILKDGSVEKAVEIVREVVEKIAKYRVPLEKLVIHEQITRDLKDYKAIGPHVSIAKRLAARGIKVKPGTIISYLVLKGSGKISDRVILLTEYDPEKHKYDADYYIENQVLPAVLRILEAFGYRKEDLRYQSSKQTGLDTWLKR

SEQ ID NO: 255 - DNA, 2361 bp, Artificial Sequence
  Rd 2 MCYP combis
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcgggaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgcgcgacggtagcgttgaaaaggcggtggagattgttcgtgaggtggtcgaaaaaatcgcgaagtaccgtgtgccgctggaaaagctggttattcacgagcaaatcacccgtgacctgaaagattataaggcgattggcccgcacgtgagcatcgcgaaacgtctggcggcgcgtggtatcaaagtgaagccgggcaccattattagctacctggttctgaaaggttcgggcaagattagcgaccgtgttatcctgctgaccgaatacgatccggagaaacacaagtatgacgcggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 256 - protein, 785 aa, Artificial Sequence
  Rd 2 MCYP combis
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSGTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILRDGSVEKAVEIVREVVEKIAKYRVPLEKLVIHEQITRDLKDYKAIGPHVSIAKRLAARGIKVKPGTIISYLVLKGSGKISDRVILLTEYDPEKHKYDADYYIENQVLPAVLRILEAFGYRKEDLRYQSSKQTGLDTWLKR

SEQ ID NO: 257 - DNA, 2361 bp, Artificial Sequence
  Rd 2 MCYP combis
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgtggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcgggaccggcaacctggtggaatggtacctgctgcgtgttgcgtatgcgcgtaacgagctggcgccgaacaaaccggatgaagaggaatacaagcgtcgtacccgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgacgtacctggtgccgctggaaaagctggttattcacgagcaaatcacccgtgacctgaaagattataaggcgattggcccgcacgtgagcatcgcgaaacgtctggcggcgcgtggtatcaaagtgaagccgggcaccattattagctacctggttctgaaaggtacgggcaagattagcgaccgtgttatcctgctgaccgaatacgatccggagaaacacaagtatgacgcggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 258 - protein, 785 aa, Artificial Sequence
  Rd 2 MCYP combis
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYVDEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSGTGNLVEWYLLRVAYARNELAPNKPDEEEYKRRTRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIATYLVPLEKLVIHEQITRDLKDYKAIGPHVSIAKRLAARGIKVKPGTIISYLVLKGTGKISDRVILLTEYDPEKHKYDADYYIENQVLPAVLRILEAFGYRKEDLRYQSSKQTGLDTWLKR

SEQ ID NO: 259 - DNA, 2361 bp, Artificial Sequence
  Rd 2 MCYP combis
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgataacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtactagcaccggcaacctggtggaatggtacctgctgcgtgttgcgtatgcgcgtaacgagctggcgccgaacaaaccggatgaagaggaatacggtcgtcgtctgcgtaccacctacctgggtggctatgtgaaagagccggaaaagggtctgtgggagaacatcatttacctggactttcgtagtctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgagatcgcgaaagagacccaggcgaaggtgctggaagcgattctgaaagacggtagcgttgaaaaggcggtggagattgttcgtgaagtggtcgaaaaaatcgcgaagtaccgtgtgccgctggaaaagctggttattcacgagcaaatcacccgtgacctgaaagattataaggcgattggcccgcacgtgagcatcgcgaaacgtctggcggctcgtggtatcaaagtgaagccgggcaccattattagctacctggttctgaaaggtagtggcaagattagcgaccgtgttatcctgctgaccgaatacgatccggagaaacacaagtatgacgcggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 260 - protein, 785 aa, Artificial Sequence
  Rd 2 MCYP combis
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRTSTGNLVEWYLLRVAYARNELAPNKPDEEEYGRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLKDYKAIGPHVSIAKRLAARGIKVKPGTIISYLVLKGSGKISDRVILLTEYDPEKHKYDADYYIENQVLPAVLRILEAFGYRKEDLRYQSSKQTGLDTWLKR

SEQ ID NO: 261 - DNA, 2361 bp, Artificial Sequence
  Rd 2 MCYP combis
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgtcggcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgacgtaccgtgtgccgctggaaaagctggttattcacgagcaaatcacccgtgacctgaaagattataaggcgattggcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacgcggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 262 - protein, 785 aa, Artificial Sequence
  Rd 2 MCYP combis
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVSAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIATYRVPLEKLVIHEQITRDLKDYKAIGPHVSIAKRLAARGIKVKPGTIISYLVLKGSGKISDRVILLTEYDPEKHKYDADYYIENQVLPAVLRILEAFGYRKEDLRYQSSKQTGLDTWLKR

SEQ ID NO: 263 - DNA, 2355 bp, Artificial Sequence
  Rd 2 MCYP SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattacgctcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctgaaagattataaggcgattggcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacgcggattactatatcgagaaccaggtgctgccggcggttctgcgtattctggaagcgttcggttaccgtaaagaggacctgcgttatcagagcagcaagcaaaccggcctggatacctggctgaaacgt

SEQ ID NO: 264 - protein, 785 aa, Artificial Sequence
  Rd 2 MCYP SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYAQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLKDYKAIGPHVSIAKRLAARGIKVKPGTIISYLVLKGSGKISDRVILLTEYDPEKHKYDADYYIENQVLPAVLRILEAFGYRKEDLRYQSSKQTGLDTWLKR

SEQ ID NO: 265 - DNA, 2361 bp, Artificial Sequence
  Rd2 Fidelity SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtgatcgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctgaaagattataaggcgattggcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacgcggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 266 - protein, 785 aa, Artificial Sequence
  Rd2 Fidelity SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRDRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLKDYKAIGPHVSIAKRLAARGIKVKPGTIISYLVLKGSGKISDRVILLTEYDPEKHKYDADYYIENQVLPAVLRILEAFGYRKEDLRYQSSKQTGLDTWLKR

SEQ ID NO: 267 - DNA, 2355 bp, Artificial Sequence
  Rd 2 MCYP SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgaatgatctgattgcgatgcgtcaggagatcaagaaaaagatgaaggcgaccattgacccaatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctgaaagattataaggcgattggcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacgcggattactatatcgagaaccaggtgctgccggcggttctgcgtattctggaagcgttcggttaccgtaaagaggacctgcgttatcagagcagcaagcaaaccggcctggatacctggctgaaacgt

SEQ ID NO: 268 - protein, 785 aa, Artificial Sequence
  Rd 2 MCYP SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILNDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLKDYKAIGPHVSIAKRLAARGIKVKPGTIISYLVLKGSGKISDRVILLTEYDPEKHKYDADYYIENQVLPAVLRILEAFGYRKEDLRYQSSKQTGLDTWLKR

SEQ ID NO: 269 - DNA, 2361 bp, Artificial Sequence
  Rd2 Fidelity SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggcgcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctgaaagattataaggcgattggcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacgcggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 270 - protein, 785 aa, Artificial Sequence
  Rd2 Fidelity SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVARRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLKDYKAIGPHVSIAKRLAARGIKVKPGTIISYLVLKGSGKISDRVILLTEYDPEKHKYDADYYIENQVLPAVLRILEAFGYRKEDLRYQSSKQTGLDTWLKR

SEQ ID NO: 271 - DNA, 2355 bp, Artificial Sequence
  Rd2 Fidelity SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatggtggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctgaaagattataaggcgattggcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacgcggattactatatcgagaaccaggtgctgccggcggttctgcgtattctggaagcgttcggttaccgtaaagaggacctgcgttatcagagcagcaagcaaaccggcctggatacctggctgaaacgt

SEQ ID NO: 272 - protein, 785 aa, Artificial Sequence
  Rd2 Fidelity SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMVATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLKDYKAIGPHVSIAKRLAARGIKVKPGTIISYLVLKGSGKISDRVILLTEYDPEKHKYDADYYIENQVLPAVLRILEAFGYRKEDLRYQSSKQTGLDTWLKR

SEQ ID NO: 273 - DNA, 2361 bp, Artificial Sequence
  Rd2 Fidelity SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagcttaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctgaaagattataaggcgattggcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacgcggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 274 - protein, 785 aa, Artificial Sequence
  Rd2 Fidelity SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIELKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLKDYKAIGPHVSIAKRLAARGIKVKPGTIISYLVLKGSGKISDRVILLTEYDPEKHKYDADYYIENQVLPAVLRILEAFGYRKEDLRYQSSKQTGLDTWLKR

SEQ ID NO: 275 - DNA, 2355 bp, Artificial Sequence
  Rd2 Fidelity SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaatgatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctgaaagattataaggcgattggcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacgcggattactatatcgagaaccaggtgctgccggcggttctgcgtattctggaagcgttcggttaccgtaaagaggacctgcgttatcagagcagcaagcaaaccggcctggatacctggctgaaacgt

SEQ ID NO: 276 - protein, 785 aa, Artificial Sequence
  Rd2 Fidelity SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKMMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLKDYKAIGPHVSIAKRLAARGIKVKPGTIISYLVLKGSGKISDRVILLTEYDPEKHKYDADYYIENQVLPAVLRILEAFGYRKEDLRYQSSKQTGLDTWLKR

SEQ ID NO: 277 - DNA, 2355 bp, Artificial Sequence
  Rd 2 MCYP SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagtacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctgaaagattataaggcgattggcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacgcggattactatatcgagaaccaggtgctgccggcggttctgcgtattctggaagcgttcggttaccgtaaagaggacctgcgttatcagagcagcaagcaaaccggcctggatacctggctgaaacgt

SEQ ID NO: 278 - protein, 785 aa, Artificial Sequence
  Rd 2 MCYP SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEYPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLKDYKAIGPHVSIAKRLAARGIKVKPGTIISYLVLKGSGKISDRVILLTEYDPEKHKYDADYYIENQVLPAVLRILEAFGYRKEDLRYQSSKQTGLDTWLKR

SEQ ID NO: 279 - DNA, 2355 bp, Artificial Sequence
  Rd 2 MCYP SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagcttatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctgaaagattataaggcgattggcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacgcggattactatatcgagaaccaggtgctgccggcggttctgcgtattctggaagcgttcggttaccgtaaagaggacctgcgttatcagagcagcaagcaaaccggcctggatacctggctgaaacgt

SEQ ID NO: 280 - protein, 785 aa, Artificial Sequence
  Rd 2 MCYP SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKLMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLKDYKAIGPHVSIAKRLAARGIKVKPGTIISYLVLKGSGKISDRVILLTEYDPEKHKYDADYYIENQVLPAVLRILEAFGYRKEDLRYQSSKQTGLDTWLKR

SEQ ID NO: 281 - DNA, 2355 bp, Artificial Sequence
  Rd2 Fidelity SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgcaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctgaaagattataaggcgattggcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacgcggattactatatcgagaaccaggtgctgccggcggttctgcgtattctggaagcgttcggttaccgtaaagaggacctgcgttatcagagcagcaagcaaaccggcctggatacctggctgaaacgt

SEQ ID NO: 282 - protein, 785 aa, Artificial Sequence
  Rd2 Fidelity SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMQATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLKDYKAIGPHVSIAKRLAARGIKVKPGTIISYLVLKGSGKISDRVILLTEYDPEKHKYDADYYIENQVLPAVLRILEAFGYRKEDLRYQSSKQTGLDTWLKR

SEQ ID NO: 283 - DNA, 2355 bp, Artificial Sequence
  Rd 2 MCYP SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagcagaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctgaaagattataaggcgattggcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacgcggattactatatcgagaaccaggtgctgccggcggttctgcgtattctggaagcgttcggttaccgtaaagaggacctgcgttatcagagcagcaagcaaaccggcctggatacctggctgaaacgt

SEQ ID NO: 284 - protein, 785 aa, Artificial Sequence
  Rd 2 MCYP SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKQKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLKDYKAIGPHVSIAKRLAARGIKVKPGTIISYLVLKGSGKISDRVILLTEYDPEKHKYDADYYIENQVLPAVLRILEAFGYRKEDLRYQSSKQTGLDTWLKR

SEQ ID NO: 285 - DNA, 2355 bp, Artificial Sequence
  Rd2 Fidelity SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagcctaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctgaaagattataaggcgattggcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacgcggattactatatcgagaaccaggtgctgccggcggttctgcgtattctggaagcgttcggttaccgtaaagaggacctgcgttatcagagcagcaagcaaaccggcctggatacctggctgaaacgt

SEQ ID NO: 286 - protein, 785 aa, Artificial Sequence
  Rd2 Fidelity SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLKDYKAIGPHVSIAKRLAARGIKVKPGTIISYLVLKGSGKISDRVILLTEYDPEKHKYDADYYIENQVLPAVLRILEAFGYRKEDLRYQSSKQTGLDTWLKR

SEQ ID NO: 287 - DNA, 2355 bp, Artificial Sequence
  Rd 2 MCYP SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgtgaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctgaaagattataaggcgattggcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacgcggattactatatcgagaaccaggtgctgccggcggttctgcgtattctggaagcgttcggttaccgtaaagaggacctgcgttatcagagcagcaagcaaaccggcctggatacctggctgaaacgt

SEQ ID NO: 288 - protein, 785 aa, Artificial Sequence
  Rd 2 MCYP SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIVKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLKDYKAIGPHVSIAKRLAARGIKVKPGTIISYLVLKGSGKISDRVILLTEYDPEKHKYDADYYIENQVLPAVLRILEAFGYRKEDLRYQSSKQTGLDTWLKR

SEQ ID NO: 289 - DNA, 2355 bp, Artificial Sequence
  Rd2 Fidelity SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtagttatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctgaaagattataaggcgattggcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacgcggattactatatcgagaaccaggtgctgccggcggttctgcgtattctggaagcgttcggttaccgtaaagaggacctgcgttatcagagcagcaagcaaaccggcctggatacctggctgaaacgt

SEQ ID NO: 290 - protein, 785 aa, Artificial Sequence
  Rd2 Fidelity SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGSYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLKDYKAIGPHVSIAKRLAARGIKVKPGTIISYLVLKGSGKISDRVILLTEYDPEKHKYDADYYIENQVLPAVLRILEAFGYRKEDLRYQSSKQTGLDTWLKR

SEQ ID NO: 291 - DNA, 2355 bp, Artificial Sequence
  Rd2 Fidelity SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtacctgtaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctgaaagattataaggcgattggcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacgcggattactatatcgagaaccaggtgctgccggcggttctgcgtattctggaagcgttcggttaccgtaaagaggacctgcgttatcagagcagcaagcaaaccggcctggatacctggctgaaacgt

SEQ ID NO: 292 - protein, 785 aa, Artificial Sequence
  Rd2 Fidelity SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTCNLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLKDYKAIGPHVSIAKRLAARGIKVKPGTIISYLVLKGSGKISDRVILLTEYDPEKHKYDADYYIENQVLPAVLRILEAFGYRKEDLRYQSSKQTGLDTWLKR

SEQ ID NO: 293 - DNA, 2355 bp, Artificial Sequence
  Rd 2 MCYP SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgttatatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctgaaagattataaggcgattggcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacgcggattactatatcgagaaccaggtgctgccggcggttctgcgtattctggaagcgttcggttaccgtaaagaggacctgcgttatcagagcagcaagcaaaccggcctggatacctggctgaaacgt

SEQ ID NO: 294 - protein, 785 aa, Artificial Sequence
  Rd 2 MCYP SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRYINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLKDYKAIGPHVSIAKRLAARGIKVKPGTIISYLVLKGSGKISDRVILLTEYDPEKHKYDADYYIENQVLPAVLRILEAFGYRKEDLRYQSSKQTGLDTWLKR

SEQ ID NO: 295 - DNA, 2355 bp, Artificial Sequence
  Rd 2 MCYP SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaacttggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaatgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctgaaagattataaggcgattggcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacgcggattactatatcgagaaccaggtgctgccggcggttctgcgtattctggaagcgttcggttaccgtaaagaggacctgcgttatcagagcagcaagcaaaccggcctggatacctggctgaaacgt

SEQ ID NO: 296 - protein, 785 aa, Artificial Sequence
  Rd 2 MCYP SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQCAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLKDYKAIGPHVSIAKRLAARGIKVKPGTIISYLVLKGSGKISDRVILLTEYDPEKHKYDADYYIENQVLPAVLRILEAFGYRKEDLRYQSSKQTGLDTWLKR

SEQ ID NO: 297 - DNA, 2355 bp, Artificial Sequence
  Rd 2 MCYP SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacgtgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctgaaagattataaggcgattggcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacgcggattactatatcgagaaccaggtgctgccggcggttctgcgtattctggaagcgttcggttaccgtaaagaggacctgcgttatcagagcagcaagcaaaccggcctggatacctggctgaaacgt

SEQ ID NO: 298 - protein, 785 aa, Artificial Sequence
  Rd 2 MCYP SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINVPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLKDYKAIGPHVSIAKRLAARGIKVKPGTIISYLVLKGSGKISDRVILLTEYDPEKHKYDADYYIENQVLPAVLRILEAFGYRKEDLRYQSSKQTGLDTWLKR

SEQ ID NO: 299 - DNA, 2355 bp, Artificial Sequence
  Rd 2 MCYP SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaagatatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctgaaagattataaggcgattggcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacgcggattactatatcgagaaccaggtgctgccggcggttctgcgtattctggaagcgttcggttaccgtaaagaggacctgcgttatcagagcagcaagcaaaccggcctggatacctggctgaaacgt

SEQ ID NO: 300 - protein, 785 aa, Artificial Sequence
  Rd 2 MCYP SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKDMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLKDYKAIGPHVSIAKRLAARGIKVKPGTIISYLVLKGSGKISDRVILLTEYDPEKHKYDADYYIENQVLPAVLRILEAFGYRKEDLRYQSSKQTGLDTWLKR

SEQ ID NO: 301 - DNA, 2355 bp, Artificial Sequence
  Rd2 Fidelity SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagatgtttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctgaaagattataaggcgattggcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacgcggattactatatcgagaaccaggtgctgccggcggttctgcgtattctggaagcgttcggttaccgtaaagaggacctgcgttatcagagcagcaagcaaaccggcctggatacctggctgaaacgt

SEQ ID NO: 302 - protein, 785 aa, Artificial Sequence
  Rd2 Fidelity SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEMFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLKDYKAIGPHVSIAKRLAARGIKVKPGTIISYLVLKGSGKISDRVILLTEYDPEKHKYDADYYIENQVLPAVLRILEAFGYRKEDLRYQSSKQTGLDTWLKR

SEQ ID NO: 303 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgttggggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatataagcgtcgtctgcgtaccacctacctgggtggttatgtgaaagagccggaaaagggtctgtgggagaacatcatttacctggactttcgcagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggttgaaaaaatcgcgaagtaccgtgtgccgccggaaaagctggttattcacgagcaaatcacccgtgacctgaaggattataaggcgattagcccgcacgtgagcatcgcgaaacgtctggcgacgcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 304 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRWGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPPEKLVIHEQITRDLKDYKAISPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 305 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgttggggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggttatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaaaaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaacatggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggcgcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 306 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRWGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKHGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 307 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggttatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagatggtagcgttgaaaaggcggtggagattgttcgtgacgtggttgaaaaaatcgcgaagtaccgtgtgccgctggaaaagctggttattcacgagcaaatcacccgtgacctggatgattataaggcgattggcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 308 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAIGPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 309 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgcagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtgatcgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagatggtagcgttgaaaaggcggtggagattgttcgtgaggtggtcgaaaaaatcgcgaagtaccgtgtgccgccggaaaagctggttattcacgagcaaatcacccgtgacctggatgattataaggcgattagcccgcacgtgagcatcgcgaaacgtctggcggctcgtggtatcaaagtgaagccgggcaccattattagctacatcgttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 310 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRDRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPPEKLVIHEQITRDLDDYKAISPHVSIAKRLAARGIKVKPGTIISYIVLKGSGKISDRVILLTEYDPEKHKYDPDYYIENQVLPAVLRILEAFGYRKEDLRYQSSKQTGLDTWLKR

SEQ ID NO: 311 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatataagcgtcgtctgcgtaccacctacctgggtggttatgtgaaagagccggaaaagggtctgtgggagaacatcatttacctggactttcgcagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgcaggcgaccattgacccgatcgagaagaagatgctggattaccgtgatcgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgccggaaaagctggttattcacgagcaaatcacccgtgacctgaaggattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 312 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMQATIDPIEKKMLDYRDRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPPEKLVIHEQITRDLKDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 313 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcctgcctaagatgaaggcgaccattgacccgatcgagaagaagatgctggattaccgtcaacgtgcggttaaactgctggcgaacagctactatggttacatgggctatccgaaggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtacgaagtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 314 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEILPKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYEVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 315 - DNA, 2355 bp, Artificial Sequence
  Rd 3 MCYP combi
atgcatcaccatcaccatcacggtggcagcggtatgattctgaacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattaacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatataagcgtcgtctgcgtaccacctacctgggtggttatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgcaggcgaccattgacccgatcgagctgaagatgctggattaccgtgatcgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagatggtagcgttgaaaaggcggtggagattgttcgtgaggtggtcgaaaaaatcgcgaagtaccgtgtgccgccggaaaagctggttattcacgagcaaatcacccgtgacctgaaggattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 316 - protein, 785 aa, Artificial Sequence
  Rd 3 MCYP combi
MHHHHHHGGSGMILNTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLINKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMQATIDPIELKMLDYRDRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPPEKLVIHEQITRDLKDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 317 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacgaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcctgcctaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtacgaagtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 318 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYERRLRTTYLGGYVKEPEKGLWENIIYLDFRSLYPSIIVTHNVSPDTLEKEGCENYDIAPIVSYRFCKDFPGFIPSILGDLIAMRQEILPKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYEVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 319 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacgaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgcgtgagaagaaggtgctggattatcgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtacgaagtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 320 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYERRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPREKKVLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYEVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 321 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcctgaaaaagatgaaggcgaccattgacccgcgtgagaagaagatgctggattaccgtcaacgtgcggttaaactgctggcgaacagctactatggttacatgggctatccgaaggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtacgaagtgccgctggaaaagctggttattcacgagcaaatcacccgtgacctgaaggattataaggcgattagcccgcacgtgagcatcgcgaaacgtctggcgactcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 322 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEILKKMKATIDPREKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYEVPLEKLVIHEQITRDLKDYKAISPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 323 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagctttgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatataagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtgatcgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagatggtagcgttgaaaaggcggtggagattgttcgtgaggtggtcgaaaaaatcgcgaagtaccgtgtgccgccggaaaagctggttattcacgagcaaatcacccgtgacctggatgattataaggcgattagcccgcacgtgagcatcgcgaaacgtctggcgacgcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 324 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRDRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPPEKLVIHEQITRDLDDYKAISPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 325 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtacctgcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaaaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtacgaagtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 326 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTCNLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYEVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 327 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacgaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcctgaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 328 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYERRLRTTYLGGYVKEPEKGLWENIIYLDFRSLYPSIIVTHNVSPDTLEKEGCENYDIAPIVSYRFCKDFPGFIPSILGDLIAMRQEILKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 329 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacggtcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtacgaagtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 330 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYGRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYEVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 331 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatataagcgtcgtctgcgtaccacctacctgggtggttatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgcaggcgaccattgacccgatcgagaagaagatgctggattaccgtgatcgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaacatggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggcgcgtggtatcaaagtgaagccgggcaccattattagctacatcgttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 332 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMQATIDPIEKKMLDYRDRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKHGSVEKAVEIVREVVEKIAKYRVPLEKLVIHEQITRDLDDYKAISPHVSIAKRLAARGIKVKPGTIISYIVLKGSGKISDRVILLTEYDPEKHKYDPDYYIENQVLPAVLRILEAFGYRKEDLRYQSSKQTGLDTWLKR

SEQ ID NO: 333 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatataagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtgatcgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagatggtagcgttgaaaaggcggtggagattgttcgtgaggtgactgaaaaaatcgcgaagtaccgtgtgccgccggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 334 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRDRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVTEKIAKYRVPPEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 335 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcctgaaaaagatgaaggcgaccattgacccgatcgagaagaagatgctggattaccgtcaacgtgcggttaaactgctggcgaacagctactatggttacatgggctatccgaaggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 336 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEILKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 337 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatataagcgtcgtctgcgtaccacctacctgggtggttatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtgatcgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaacatggtagcgttgaaaaggcggtggagattgttcgtgacgtggttgaaaaaatcgcgaagtaccgtgtgccgccggaaaagctggttattcacgagcaaatcacccgtgacctggatgattataaggcgattagcccgcacgtgagcatcgcgaaacgtctggcggcgcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 338 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRDRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKHGSVEKAVEIVRDVVEKIAKYRVPPEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 339 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacggtcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcctgaaaaagatgaaggcgaccattgacccgattgagaagaaggtgctggattatcgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtacgaagtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 340 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYGRRLRTTYLGGYVKEPEKGLWENIIYLDFRSLYPSIIVTHNVSPDTLEKEGCENYDIAPIVSYRFCKDFPGFIPSILGDLIAMRQEILKKMKATIDPIEKKVLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYEVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 341 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacggtcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgcgtgagaagaagatgctggataatcgtcaacgtgcggttaaactgctggcgaacagctactatggttacatgggctatccgaaggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtacgaagtgccgctggaaaagctggttattcacgagcaaatcacccgtgacctgaaggattataaggcgattagcccgcacgtgagcatcgcgaaacgtctggcgactcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 342 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYGRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPREKKMLDNRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYEVPLEKLVIHEQITRDLKDYKAISPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 343 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcctgcctaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtacgaagtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 344 - protein, 785 aa, Artificial Sequence; identical to SEQ ID NO: 314
  Rd 3 MCYP combi

SEQ ID NO: 345 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtacctgcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacggtcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaaaaaaagatgaaggcgaccattgacccgattgagaagaagatgctggataatcgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcggccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtacgaagtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 346 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTCNLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYGRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDNRQRAVKLLANSYYGYMGYPKARWYSKECAESVTAWGRHYIEMTIKEIEEKFGFKVLYADTDGFYAAIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYEVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 347 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgcgtgagaagaagatgctggataatcgtcaacgcgcggttaaactgctggcgaacagctactatggttacatgggctatccgaaggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctgaaggattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 348 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPREKKMLDNRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLKDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 349 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtgatcgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggttgaaaaaatcgcgaagtaccgtgtgccgctggaaaagctggttattcacgagcaaatcacccgtgacctgaaggattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 350 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRDRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLKDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 351 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaacaaaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtgatcgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagatggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 352 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEQKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRDRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 353 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcagagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtgactgaaaaaatcgcgaagtaccgtgtgccgccggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 354 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFQSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVTEKIAKYRVPPEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 355 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcctgaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 356 - protein, 785 aa, Artificial Sequence; identical to SEQ ID NO: 336
  Rd 3 MCYP combi

SEQ ID NO: 357 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatataagcgtcgtctgcgtaccacctacctgggtggttatgtgaaagagccggaaaagggtctgtgggagaacatcatttacctggactttcagagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagctgaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagatggtagcgttgaaaaggcggtggagattgttcgtgacgtgactgaaaaaatcgcgaagtaccgtgtgccgccggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 358 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFQSLYPSIIVTHNVSPDTLEKEGCENYDIAPIVSYRFCKDFPGFIPSILGDLIAMRQEIKKKMKATIDPIELKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVTEKIAKYRVPPEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 359 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtacctgcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcctgaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtacgaagtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 360 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTCNLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEILKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYEVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 361 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtgatcgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagatggtagcgttgaaaaggcggtggagattgttcgtgaggtggtcgaaaaaatcgcgaagtaccgtgtgccgctggaaaagctggttattcacgagcaaatcacccgtgacctgaaggattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 362 - protein, 785 aa, Artificial Sequence; identical to SEQ ID NO: 350
  Rd 3 MCYP combi

SEQ ID NO: 363 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagctgaagatgctggattaccgtgatcgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagatggtagcgttgaaaaggcggtggagattgttcgtgaggtgactgaaaaaatcgcgaagtaccgtgtgccgccggaaaagctggttattcacgagcaaatcacccgtgacctgaaggattataaggcgattagcccgcacgtgagcatcgcgaaacgtctggcgacgcgtggtatcaaagtgaagccgggcaccattattagctacatcgttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 364 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIELKMLDYRDRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVTEKIAKYRVPPEKLVIHEQITRDLKDYKAISPHVSIAKRLATRGIKVKPGTIISYIVLKGSGKISDRVILLTEYDPEKHKYDPDYYIENQVLPAVLRILEAFGYRKEDLRYQSSKQTGLDTWLKR

SEQ ID NO: 365 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtacctgcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacgaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcctgaaaaagatgaaggcgaccattgacccgatcgagaagaagatgctggattatcgtcaacgtgcggttaaactgctggcgaacagctactatggttacatgggctatccgaaggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctgaaggattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 366 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTCNLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYERRLRTTYLGGYVKEPEKGLWENIIYLDFRSLYPSIIVTHNVSPDTLEKEGCENYDIAPIVSYRFCKDFPGFIPSILGDLIAMRQEILKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLKDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 367 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatataagcgtcgtctgcgtaccacctacctgggtggttatgtgaaagagccggaaaagggtctgtgggagaacatcatttacctggactttggcagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagatggtagcgttgaaaaggcggtggagattgttcgtgaggtggttgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 368 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFGSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 369 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtacctgcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacggtcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtacgaagtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 370 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTCNLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYGRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYEVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 371 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgtggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgcagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtgatcgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaacatggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 372 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRVEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRDRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKHGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 373 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtacctgcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgcgtgagaagaagatgctggataatcgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtacgaagtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 374 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTCNLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPREKKMLDNRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYEVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 375 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaaggtgctggattatcgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 376 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKVLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 377 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaacaaaagcgtcgtctgcgtaccacctacctgggtggttatgtgaaagagccggaaaagggtctgtgggagaacatcatttacctggactttcagagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggcgcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 378 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEQKRRLRTTYLGGYVKEPEKGLWENIIYLDFQSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 379 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgttggggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaacataagcgtcgtctgcgtaccacctacctgggtggttatgtgaaagagccggaaaagggtctgtgggagaacatcatttacctggactttcagagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 380 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRWGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEHKRRLRTTYLGGYVKEPEKGLWENIIYLDFQSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 381 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtgatcgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaacatggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 382 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRDRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKHGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 383 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgggcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 384 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHGQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 385 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcagagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaaaaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 386 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFQSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 387 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgcgtgagaagaaggtgctggattatcgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 388 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPREKKVLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 389 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaacaaaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaaagacatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagatggtagcgttgaaaaggcggtggagattgttcgtgaggtggtcgaaaaaatcgcgaagtaccgtgtgccgccggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 390 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEQKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKDMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPPEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 391 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatataagcgtcgtctgcgtaccacctacctgggtggttatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtgatcgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaacatggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 392 - protein, 785 aa, Artificial Sequence; identical to SEQ ID NO: 382
  Rd 3 MCYP combi

SEQ ID NO: 393 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatataagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaaaaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgccggaaaagctggttattcacgagcaaatcacccgtgacctggatgattataaggcgattagcccgcacgtgagcatcgcgaaacgtctggcggcgcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 394 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPPEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 395 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatataagcgtcgtctgcgtaccacctacctgggtggctatgtgaaagagccggaaaagggtctgtgggagaacatcatttacctggactttcagagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgcaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagatggtagcgttgaaaaggcggtggagattgttcgtgacgtggttgaaaaaatcgcgaagtaccgtgtgccgctggaaaagctggttattcacgagcaaatcacccgtgacctggatgattataaggcgattagcccgcacgtgagcatcgcgaaacgtctggcgacgcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 396 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFQSLYPSIIVTHNVSPDTLEKEGCENYDIAPIVSYRFCKDFPGFIPSILGDLIAMRQEIKKKMQATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 397 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaacaaaagcgtcgtctgcgtaccacctacctgggtggctatgtgaaagagccggaaaagggtctgtgggagaacatcatttacctggactttcagagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 398 - protein, 785 aa, Artificial Sequence; identical to SEQ ID NO: 378
  Rd 3 MCYP combi

SEQ ID NO: 399 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacgaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgattgagaagaaggtgctggataatcgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 400 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYERRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKVLDNRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 401 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtagttatgtgaaagagccggaaaagggtctgtgggagaacatcatttacctggactttcgcagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagctgaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggttgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 402 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGSYVKEPEKGLWENIIYLDFRSLYPSIIVTHNVSPDTLEKEGCENYDIAPIVSYRFCKDFPGFIPSILGDLIAMRQEIKKKMKATIDPIELKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 403 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcctgaaaaagatgaaggcgaccattgacccgcgtgagaagaagatgctggattaccgtcaacgtgcggttaaactgctggcgaacagctactatggttacatgggctatccgaaggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 404 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEILKKMKATIDPREKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 405 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacgaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 406 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYERRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 407 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgttggggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaacaaaagcgtcgtctgcgtaccacctacctgggtggttatgtgaaagagccggaaaagggtctgtgggagaacatcatttacctggactttcagagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaacatggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 408 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRWGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEQKRRLRTTYLGGYVKEPEKGLWENIIYLDFQSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKHGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 409 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtacctgcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacgaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgcgtgagaagaaggtgctggattatcgtcaacgtgcggttaaactgctggcgaacagctactatggttacatgggctatccgaaggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 410 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTCNLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYERRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPREKKVLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 411 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcagagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagctgaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 412 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFQSLYPSIIVTHNVSPDTLEKEGCENYDIAPIVSYRFCKDFPGFIPSILGDLIAMRQEIKKKMKATIDPIELKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 413 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtacctgcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaaaaaaagatgaaggcgaccattgacccgcgtgagaagaaggtgctggataatcgtcaacgtgcggttaaactgctggcgaacagctactatggttacatgggctatccgaaggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtacgaagtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 414 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTCNLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPREKKVLDNRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYEVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 415 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgattgagaagaaggtgctggattatcgtcaacgtgcggttaaactgctggcgaacagctactatggttacatgggctatccgaaggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtacgaagtgccgctggaaaagctggttattcacgagcaaatcacccgtgacctggatgattataaggcgattagcccgcacgtgagcatcgcgaaacgtctggcggctcgtggtatcaaagtgaagccgggcaccgttattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 416 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKVLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYEVPLEKLVIHEQITRDLDDYKAISPHVSIAKRLAARGIKVKPGTVISYLVLKGSGKISDRVILLTEYDPEKHKYDPDYYIENQVLPAVLRILEAFGYRKEDLRYQSSKQTGLDTWLKR

SEQ ID NO: 417 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtacctgcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaaaaaaagatgaaggcgaccattgacccgcgtgagaagaaggtgctggattatcgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtacgaagtgccgctggaaaagctggttattcacgagcaaatcacccgtgacctggatgattataaggcgattagtccgcacgtgagcatcgcgaaacgtctggcgactcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 418 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTCNLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPREKKVLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYEVPLEKLVIHEQITRDLDDYKAISPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 419 - DNA, 2355 bp, Artificial Sequence; identical to SEQ ID NO: 405
  Rd 3 MCYP combi

SEQ ID NO: 420 - protein, 785 aa, Artificial Sequence; identical to SEQ ID NO: 406
  Rd 3 MCYP combi

SEQ ID NO: 421 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtagttatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgccggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 422 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGSYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPPEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 423 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcctgaaaaagatgaaggcgaccattgacccgatcgagaagaagatgctggattatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 424 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEILKKMKATIDPIEKKMLDYRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 425 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatataagcgtcgtctgcgtaccacctacctgggtagttatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgcaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggttgaaaaaatcgcgaagtaccgtgtgccgccggaaaagctggttattcacgagcaaatcacccgtgacctggatgattataaggcgattagcccgcacgtgagcatcgcgaaacgtctggcgacgcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 426 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGSYVKEPEKGLWENIIYLDFRSLYPSIIVTHNVSPDTLEKEGCENYDIAPIVSYRFCKDFPGFIPSILGDLIAMRQEIKKKMQATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPPEKLVIHEQITRDLDDYKAISPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 427 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatataagcgtcgtctgcgtaccacctacctgggtggttatgtgaaagagccggaaaagggtctgtgggagaacatcatttacctggactttcagagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaaaaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagatggtagcgttgaaaaggcggtggagattgttcgtgaggtggttgaaaaaatcgcgaagtaccgtgtgccgctggaaaagctggttattcacgagcaaatcacccgtgacctgaaggattataaggcgattagcccgcacgtgagcatcgcgaaacgtctggcggcgcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 428 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFQSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLKDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 429 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatataagcgtcgtctgcgtaccacctacctgggtggttatgtgaaagagccggaaaagggtctgtgggagaacatcatttacctggactttggcagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagatggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggcgcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 430 - protein, 785 aa, Artificial Sequence; identical to SEQ ID NO: 368
  Rd 3 MCYP combi

SEQ ID NO: 431 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaacaaaagcgtcgtctgcgtaccacctacctgggtagttatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagatggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggcgcgtggtatcaaagtgaagccgggcaccattattagctacatcgttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 432 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEQKRRLRTTYLGSYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYIVLKGSGKISDRVILLTEYDPEKHKYDPDYYIENQVLPAVLRILEAFGYRKEDLRYQSSKQTGLDTWLKR

SEQ ID NO: 433 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtacctgcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 434 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTCNLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 435 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtacctgcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacggtcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcctgaaaaagatgaaggcgaccattgacccgatcgagaagaagatgctggattatcgtcaacgtgcggttaaactgctggcgaacagctactatggttacatgggctatccgaaggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 436 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTCNLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYGRRLRTTYLGGYVKEPEKGLWENIIYLDFRSLYPSIIVTHNVSPDTLEKEGCENYDIAPIVSYRFCKDFPGFIPSILGDLIAMRQEILKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 437 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacggtcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgattgagaagaagatgctggataatcgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 438 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYGRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDNRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 439 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcctgcctaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 440 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEILPKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 441 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgcagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtgatcgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagatggtagcgttgaaaaggcggtggagattgttcgtgaggtggttgaaaaaatcgcgaagtaccgtgtgccgctggaaaagctggttattcacgagcaaatcacccgtgacctggatgattataaggcgattagcccgcacgtgagcatcgcgaaacgtctggcgacgcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 442 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRDRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 443 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacgaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgcgtgagaagaaggtgctggattatcgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctgaaggattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 444 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYERRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPREKKVLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 445 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaaaaaaagatgaaggcgaccattgacccgcgtgagaagaagatgctggataatcgtcaacgtgcggttaaactgctggcgaacagctactatggttacatgggctatccgaaggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 446 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPREKKMLDNRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 447 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatataagcgtcgtctgcgtaccacctacctgggtggttatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtgatcgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagatggtagcgttgaaaaggcggtggagattgttcgtgacgtggttgaaaaaatcgcgaagtaccgtgtgccgctggaaaagctggttattcacgagcaaatcacccgtgacctggatgattataaggcgattggcccgcacgtgagcatcgcgaaacgtctggcggcgcgtggtatcaaagtgaagccgggcaccattattagctacatcgttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 448 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRDRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAIGPHVSIAKRLAARGIKVKPGTIISYIVLKGSGKISDRVILLTEYDPEKHKYDPDYYIENQVLPAVLRILEAFGYRKEDLRYQSSKQTGLDTWLKR

SEQ ID NO: 449 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgattgagaagaaggtgctggattatcgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctgaaggattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 450 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKVLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 451 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtacctgcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtacgaagtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 452 - protein, 785 aa, Artificial Sequence; identical to SEQ ID NO: 326
  Rd 3 MCYP combi

SEQ ID NO: 453 - DNA, 2355 bp, Artificial Sequence; identical to SEQ ID NO: 433
  Rd 3 MCYP combi

SEQ ID NO: 454 - protein, 785 aa, Artificial Sequence; identical to SEQ ID NO: 434
  Rd 3 MCYP combi

SEQ ID NO: 455 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtacctgcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacggtcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtacgaagtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 456 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTCNLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYGRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYEVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 457 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaaaaaaagatgaaggcgaccattgacccgattgagaagaagatgctggataatcgtcaacgtgcggttaaactgctggcgaacagctactatggttacatgggctatccgaaggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 458 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDNRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 459 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaaaaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggttgaaaaaatcgcgaagtaccgtgtgccgccggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 460 - protein, 785 aa, Artificial Sequence; identical to SEQ ID NO: 394
  Rd 3 MCYP combi

SEQ ID NO: 461 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgattgagaagaagatgctggataatcgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctgaaggattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 462 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDNRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 463 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgttggggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatataagcgtcgtctgcgtaccacctacctgggtagttatgtgaaagagccggaaaagggtctgtgggagaacatcatttacctggactttcagagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgcaggcgaccattgacccgatcgagaaaaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaacatggtagcgttgaaaaggcggtggagattgttcgtgaggtggtcgaaaaaatcgcgaagtaccgtgtgccgccggaaaagctggttattcacgagcaaatcacccgtgacctgaaggattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 464 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRWGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGSYVKEPEKGLWENIIYLDFQSLYPSIIVTHNVSPDTLEKEGCENYDIAPIVSYRFCKDFPGFIPSILGDLIAMRQEIKKKMQATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKHGSVEKAVEIVREVVEKIAKYRVPPEKLVIHEQITRDLKDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 465 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtacctgcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacggtcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcctgaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 466 - protein, 785 aa, Artificial Sequence; identical to SEQ ID NO: 436
  Rd 3 MCYP combi

SEQ ID NO: 467 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgcaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagatggtagcgttgaaaaggcggtggagattgttcgtgaggtggtcgaaaaaatcgcgaagtaccgtgtgccgccggaaaagctggttattcacgagcaaatcacccgtgacctggatgattataaggcgattagcccgcacgtgagcatcgcgaaacgtctggcgacgcgtggtatcaaagtgaagccgggcaccattattagctacatcgttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 468 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMQATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPPEKLVIHEQITRDLDDYKAISPHVSIAKRLATRGIKVKPGTIISYIVLKGSGKISDRVILLTEYDPEKHKYDPDYYIENQVLPAVLRILEAFGYRKEDLRYQSSKQTGLDTWLKR

SEQ ID NO: 469 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatataagcgtcgtctgcgtaccacctacctgggtggttatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtgatcgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagatggtagcgttgaaaaggcggtggagattgttcgtgaggtgactgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 470 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRDRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVTEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 471 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtacctgcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgattgagaagaaggtgctggataatcgtcaacgtgcggttaaactgctggcgaacagctactatggttacatgggctatccgaaggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtacgaagtgccgctggaaaagctggttattcacgagcaaatcacccgtgacctggatgattataaggcgattagcccgcacgtgagcatcgcgaaacgtctggcgactcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 472 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTCNLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKVLDNRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYEVPLEKLVIHEQITRDLDDYKAISPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 473 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacggtcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaaaaaaagatgaaggcgaccattgacccgattgagaagaaggtgctggataatcgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 474 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYGRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKVLDNRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 475 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaaaaaaagatgaaggcgaccattgacccgattgagaagaaggtgctggataatcgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtacgaagtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 476 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKVLDNRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYEVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 477 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgattgagaagaaggtgctggattatcgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 478 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPIEKKVLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 479 - DNA, 2355 bp, Artificial Sequence; identical to SEQ ID NO: 27
  Rd 3 MCYP combi

SEQ ID NO: 480 - protein, 785 aa, Artificial Sequence; identical to SEQ ID NO: 28
  Rd 3 MCYP combi

SEQ ID NO: 481 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 482 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 483 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtacctgcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgcgtgagaagaagatgctggattatcgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 484 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTCNLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPREKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 485 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgttggggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggttatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgcaggcgaccattgacccgatcgagaagaagatgctggattaccgtgatcgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaacatggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggcgcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 486 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRWGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMQATIDPIEKKMLDYRDRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKHGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 487 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccacgtgagaagaagatgctggattatcgtcaacgtgcggttaaactgctggcgaacagctactatggttacatgggctatccgaaggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 488 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPREKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 489 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacggtcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaaaaaaagatgaaggcgaccattgacccgattgagaagaaggtgctggattatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctgaaggattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 490 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYGRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKVLDYRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 491 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtacctgcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 492 - protein, 785 aa, Artificial Sequence; identical to SEQ ID NO: 434
  Rd 3 MCYP combi

SEQ ID NO: 493 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaacaaaagcgtcgtctgcgtaccacctacctgggtggctatgtgaaagagccggaaaagggtctgtgggagaacatcatttacctggactttcgcagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagatggtagcgttgaaaaggcggtggagattgttcgtgaggtggttgaaaaaatcgcgaagtaccgtgtgccgccggaaaagctggttattcacgagcaaatcacccgtgacctgaaggattataaggcgattagcccgcacgtgagcatcgcgaaacgtctggcggcgcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 494 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEQKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPPEKLVIHEQITRDLKDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 495 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtacctgcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcctgaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctgaaggattataaggcgattagcccgcacgtgagcatcgcgaaacgtctggcgactcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 496 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTCNLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEILKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAISPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 497 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatataagcgtcgtctgcgtaccacctacctgggtggctatgtgaaagagccggaaaagggtctgtgggagaacatcatttacctggactttcagagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggttgaaaaaatcgcgaagtaccgtgtgccgctggaaaagctggttattcacgagcaaatcacccgtgacctggatgattataaggcgattagcccgcacgtgagcatcgcgaaacgtctggcgacgcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 498 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFQSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 499 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatataagcgtcgtctgcgtaccacctacctgggtagttatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagctgaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggttgaaaaaatcgcgaagtaccgtgtgccgccggaaaagctggttattcacgagcaaatcacccgtgacctggatgattataaggcgattagcccgcacgtgagcatcgcgaaacgtctggcggcgcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 500 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGSYVKEPEKGLWENIIYLDFRSLYPSIIVTHNVSPDTLEKEGCENYDIAPIVSYRFCKDFPGFIPSILGDLIAMRQEIKKKMKATIDPIELKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPPEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 501 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtacctgcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaaaaaaagatgaaggcgaccattgacccgcgtgagaagaagatgctggataatcgtcaacgtgcggttaaactgctggcgaacagctactatggttacatgggctatccgaaggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 502 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTCNLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPREKKMLDNRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 503 - DNA, 2355 bp, Artificial Sequence; identical to SEQ ID NO: 433
  Rd 3 MCYP combi

SEQ ID NO: 504 - protein, 785 aa, Artificial Sequence; identical to SEQ ID NO: 434
  Rd 3 MCYP combi

SEQ ID NO: 505 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgcgtgagaagaaggtgctggataatcgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 506 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPREKKVLDNRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 507 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgattgagaagaaggtgctggattatcgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtacgaagtgccgctggaaaagctggttattcacgagcaaatcacccgtgacctgaaggattataaggcgattagtccgcacgtgagcatcgcgaaacgtctggcggctcgtggtatcaaagtgaagccgggcaccgttattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 508 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKVLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYEVPLEKLVIHEQITRDLKDYKAISPHVSIAKRLAARGIKVKPGTVISYLVLKGSGKISDRVILLTEYDPEKHKYDPDYYIENQVLPAVLRILEAFGYRKEDLRYQSSKQTGLDTWLKR

SEQ ID NO: 509 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggataatcgtcaacgtgcggttaaactgctggcgaacagctactatggttacatgggctatccgaaggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 510 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDNRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 511 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtacctgcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaaaaaaagatgaaggcgaccattgacccgatcgagaagaaggtgctggataatcgtcaacgtgcggttaaactgctggcgaacagctactatggttacatgggctatccgaaggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtacgaagtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 512 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTCNLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKVLDNRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYEVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 513 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtagttatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggcgcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 514 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGSYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 515 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 516 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 517 - DNA, 2355 bp, Artificial Sequence
  Rd 3 MCYP combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgttggggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatataagcgtcgtctgcgtaccacctacctgggtagttatgtgaaagagccggaaaagggtctgtgggagaacatcatttacctggactttcagagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 518 - protein, 785 aa, Artificial Sequence
  Rd 3 MCYP combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRWGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGSYVKEPEKGLWENIIYLDFQSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 519 - DNA, 2355 bp, Artificial Sequence
  Rd3 Fidelity SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgcgtgagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 520 - protein, 785 aa, Artificial Sequence
  Rd3 Fidelity SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIARETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 521 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaaggt

SEQ ID NO: 522 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKG

SEQ ID NO: 523 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttattgtgttattgatgaggaaggtcgtatcaccacccgtggtctggaagtggttcgtcgtgactggagcgaaatcgcgaaagagacccaggcgaaggtgctggaagcgattctgaaagaccagagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 524 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYCVIDEEGRITTRGLEVVRRDWSEIAKETQAKVLEAILKDQSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 525 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaacccagctggatacctggctgaaacgt

SEQ ID NO: 526 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTQLDTWLKR

SEQ ID NO: 527 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgagttacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 528 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLSYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 529 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtgcgttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 530 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRAFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 531 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgatgtacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 532 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLMYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 533 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagaccggagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 534 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDRSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 535 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgcagtacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctacgtattctggaagctttcggttaccgtaaagaggacctgcgttatcagagcagcaagcaaaccggcctggatacctggctgaaacgt

SEQ ID NO: 536 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLQYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 537 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatccagatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 538 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIQMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 539 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatggtagcagcaagcaaaccggcctggatacctggctgaaacgt

SEQ ID NO: 540 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYGSSKQTGLDTWLKR

SEQ ID NO: 541 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcaatatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 542 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYINMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 543 - DNA, 2355 bp, Artificial Sequence
  Rd3 Fidelity SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaagatggcctggatacctggctgaaacgt

SEQ ID NO: 544 - protein, 785 aa, Artificial Sequence
  Rd3 Fidelity SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQDGLDTWLKR

SEQ ID NO: 545 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaaagtgttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 546 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLESVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 547 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgtttgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 548 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAFEFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 549 - DNA, 2355 bp, Artificial Sequence
  Rd3 Fidelity SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattggggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 550 - protein, 785 aa, Artificial Sequence
  Rd3 Fidelity SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIGEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 551 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcacgatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 552 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYITMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 553 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgcgttacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 554 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLRYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 555 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcgatgatacctggctgaaacgt

SEQ ID NO: 556 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGDDTWLKR

SEQ ID NO: 557 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaagggccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 558 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEGPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 559 - DNA, 2355 bp, Artificial Sequence
  Rd3 Fidelity SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagtgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccgttaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 560 - protein, 785 aa, Artificial Sequence
  Rd3 Fidelity SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTVKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 561 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaggctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcgacgctgcgtattctggaagctttcggttaccgtaaagaggacctgcgttatcagagcagcaagcaaaccggcctggatacctggctgaaacgt

SEQ ID NO: 562 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAERLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPATLRILEAFGYRKEDLRYQSSKQTGLDTWLKR

SEQ ID NO: 563 - DNA, 2355 bp, Artificial Sequence
  Rd3 Fidelity SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaagtcgctgtacgcggacaccgatggtttctatgcgaccattccgggcgaaaagccggagatcattaaaaagaaagcgcaggagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 564 - protein, 785 aa, Artificial Sequence
  Rd3 Fidelity SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKSLYADTDGFYATIPGEKPEIIKKKAQEFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 565 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgtatctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 566 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVYLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 567 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagtatgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 568 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEYVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 569 - DNA, 2355 bp, Artificial Sequence
  Rd3 Fidelity SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtggctctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 570 - protein, 785 aa, Artificial Sequence
  Rd3 Fidelity SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVALVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 571 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcgtttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 572 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIVYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 573 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtgttctggaagctttcggttaccgtaaagaggacctgcgttatcagagcagcaagcaaaccggcctggatacctggctgaaacgt

SEQ ID NO: 574 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRVLEAFGYRKEDLRYQSSKQTGLDTWLKR

SEQ ID NO: 575 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatggctgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 576 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMADKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 577 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatggtggataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcagggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 578 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMVDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSRECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 579 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagaagatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctggtgtacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 580 - protein, 785 aa, Artificial Sequence
  Rd 3 SNOCAPS
MHHHHHHGGSGMILDTDYITKDGKPIIRIFKKENGEFKIELDPHFQPYIYALLKEDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLVYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 581 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgcagtacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaacaggacctgcgttatcagagcagcaagcaaaccggcctggatacctggctgaaacgt

SEQ ID NO: 582 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLQYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKQDLRYQSSKQTGLDTWLKR

SEQ ID NO: 583 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgagggtaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 584 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEGKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 585 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggcgacctggctgaaacgt

SEQ ID NO: 586 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLATWLKR

SEQ ID NO: 587 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaaggggacctgcgttatcagagcagcaagcaaaccggcctggatacctggctgaaacgt

SEQ ID NO: 588 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKGDLRYQSSKQTGLDTWLKR

SEQ ID NO: 589 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgctaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctgggaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 590 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLGKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 591 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggggatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 592 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPGIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 593 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtggaatgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 594 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWNVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 595 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacgatctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 596 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYDLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 597 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaaggccaaaagcaagctgggcgcggaagagattgcggcgatctgggagaccgaagagagcatggggaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 598 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKAKSKLGAEEIAAIWETEESMGKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 599 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgttcgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccgttgatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 600 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPLIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 601 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcatttttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 602 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGIFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 603 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatgcggcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 604 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDAAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 605 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcatgtttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 606 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGMFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 607 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagagcagtacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 608 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEQYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 609 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgggtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 610 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMGDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 611 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtggcctgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 612 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWPVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 613 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatctggcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 614 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDLAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 615 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtactgtaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 616 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYCKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 617 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaatgtgttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 618 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLECVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 619 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgtttgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 620 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMFDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 621 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgacctctaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 622 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTSKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 623 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcctgtttgtgaccaagaaacgttatgcggttattgatgaggaaggtcgtatcaccacccgtggtctggaagtggttcgtcgtgactggagcgaaatcgcgaaagagacccagcttaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 624 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGLFVTKKRYAVIDEEGRITTRGLEVVRRDWSEIAKETQLKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 625 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctgtggacctggctgaaacgt

SEQ ID NO: 626 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLWTWLKR

SEQ ID NO: 627 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagcggaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 628 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKRKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 629 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccgcctgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 630 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPPEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 631 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatggagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 632 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMEKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 633 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgtatgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagtgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 634 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPYVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 635 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaaactgacctgcgttatcagagcagcaagcaaaccggcctggatacctggctgaaacgt

SEQ ID NO: 636 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKTDLRYQSSKQTGLDTWLKR

SEQ ID NO: 637 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaggccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 638 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNRPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 639 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaacctaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 640 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKPNPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 641 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaagcatggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 642 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKHGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 643 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggtggttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 644 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWVVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 645 - DNA, 2355 bp, Artificial Sequence
  Rd3 Fidelity SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacactctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 646 - protein, 785 aa, Artificial Sequence
  Rd3 Fidelity SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYTLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 647 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccgcttaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 648 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPLKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 649 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccgaggaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 650 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPRKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 651 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaaggagaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 652 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKEKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 653 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagctttctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 654 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSFLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 655 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgtatgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 656 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMYDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 657 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacagtgaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 658 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDSENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 659 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaaggctaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 660 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKAKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 661 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttattcgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 662 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVIRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 663 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggctaggatacctggctgaaacgt

SEQ ID NO: 664 - protein, 778 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTG

SEQ ID NO: 665 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaaggcgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctggcgtacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 666 - protein, 785 aa, Artificial Sequence
  Rd 3 SNOCAPS
MHHHHHHGGSGMILDTDYITKDGKPIIRIFKKENGEFKIELDPHFQPYIYALLKGDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLAYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 667 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgtggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaaggggctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 668 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIVAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 669 - DNA, 2355 bp, Artificial Sequence
  Rd3 Fidelity SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaactggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 670 - protein, 785 aa, Artificial Sequence
  Rd3 Fidelity SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKLDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 671 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctggcgtacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 672 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLAYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 673 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgacggagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 674 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKATEFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 675 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgtgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 676 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMCDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 677 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgtctgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 678 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMSDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 679 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgtctaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 680 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMSKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 681 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaagcgatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 682 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQAMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 683 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggataccgtgctgaaacgt

SEQ ID NO: 684 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTVLKR

SEQ ID NO: 685 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggctaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 686 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPAKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 687 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgcttgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 688 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPLVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 689 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccgggaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 690 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTGKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 691 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgacccagaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 692 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTQKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 693 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtactctctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 694 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYSLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 695 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgcagcctgtatccgagcatcattgtgacccacaacgttagcccggacaccctggagaaggaaggctgcgtgaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 696 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCVNYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 697 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactggtgggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 698 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLVGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 699 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggtggaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 700 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPVEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 701 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggaggctgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 702 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEAVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 703 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcgtttttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 704 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGVFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 705 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacattgaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 706 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDIENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 707 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagggagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 708 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEGSMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 709 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaggtga

SEQ ID NO: 710 - protein, 784 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLR

SEQ ID NO: 711 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgacccataaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 712 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTHKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 713 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagagcggtacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 714 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEERYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 715 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgggagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 716 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIGSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 717 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcgagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgtgagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 718 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGETKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 719 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggactcgagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 720 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDSSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 721 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagaggtggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 722 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEVEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 723 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagcagaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 724 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKQKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 725 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagaccagagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 726 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDQSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 727 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtatttttaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccgggggaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 728 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPGEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 729 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccgtctaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 730 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPSKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 731 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccgtataagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 732 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPYKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 733 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctctctgaaacgt

SEQ ID NO: 734 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTSLKR

SEQ ID NO: 735 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgcatgagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 736 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLHENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 737 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgcataaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 738 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMHKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 739 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgactaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttacgataaagaggacctgcgttatcagagcagcaagcaaaccggcctggatacctggctgaaacgt

SEQ ID NO: 740 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYDKEDLRYQSSKQTGLDTWLKR

SEQ ID NO: 741 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccctttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatctgtagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 742 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETLYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPICSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 743 - DNA, 2355 bp, Artificial Sequence
  Rd 3 SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaacagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 744 - protein, 785 aa, Artificial Sequence
  Rd 3 SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEQPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 745 - DNA, 2355 bp, Artificial Sequence
  Rd 4 combis
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtacctgtaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttttttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcattctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtgacggaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccatcattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 746 - protein, 785 aa, Artificial Sequence
  Rd 4 combis
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTCNLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVTEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 747 - DNA, 2355 bp, Artificial Sequence
  Rd 4 combis
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcattctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 748 - protein, 785 aa, Artificial Sequence
  Rd 4 combis
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 749 - DNA, 2355 bp, Artificial Sequence
  Rd 4 combis
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcttcctgggcgcggaagagattgcggcgatctgggagaccgaagagagcatgaagaaactggcgcagtacagcatggaagatgcgcgtgcgacctatgaactgggcaaggagttttttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 750 - protein, 785 aa, Artificial Sequence
  Rd 4 combis
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSFLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 751 - DNA, 2355 bp, Artificial Sequence
  Rd 4 combis
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtacctgcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggaggcttttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcattctgggcgatctgattgcgatgcgtcaggagatcaaacctaagatgaaggcgaccattgacccgcgtgagaaggacgtgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctggcgtacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccgtcattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 752 - protein, 785 aa, Artificial Sequence
  Rd 4 combis
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTCNLPTYTLEAVYEAVLGKTKSKLGAEEIAAIWETEESMKKLAQYSMEDARATYELGKEAFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKDVLDNRQRAVKLLANSYYGYMGYPLARWYSKECAESVTAWGRHYIEMTIKEIEEKFGFKVLYADTDGFYATIPGEKPEIIKKKAREFLAYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTVISYLVLKGSGKISDRVILLTEYDPEKHKYDPDYYIENQVLPAVLRILEAFGYRKEDLRYQSSKQTGLDTWLKR

SEQ ID NO: 753 - DNA, 2355 bp, Artificial Sequence
  Rd 4 combis
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtacctgcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaacagaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcgcactgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccagtaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccgtcattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 754 - protein, 785 aa, Artificial Sequence
  Rd 4 combis
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTCNLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEQKRRLRTTYLGGYVKEPEKGLWENIIYLDFRSLYPSIIVTHNVSPDTLEKEGCENYDIAPIVSYRFCKDFPGFIPSALGDLIAMRQEIKPKMKATIDPREKKMLDNRQRAVKLLANSYYGYMGYPLARWYSKECAESVTAWGRHYIEMTSKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTVISYLVLKGSGKISDRVILLTEYDPEKHKYDPDYYIENQVLPAVLRILEAFGYRKEDLRYQSSKQTGLDTWLKR

SEQ ID NO: 755 - DNA, 2355 bp, Artificial Sequence
  Rd 4 combis
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcattctgggcgatctgattgcgatgcgtcaggagatcaaacctaagatgaaggcgaccattgacccgcgtgagaagaaatcgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 756 - protein, 785 aa, Artificial Sequence
  Rd 4 combis
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKSLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 757 - DNA, 2355 bp, Artificial Sequence
  Rd 4 combis
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaaccgaacccggagccgaagatccaacgtatgggtgatagcttcgcggtggagattaaaggccgtatccacttcgacctgtttccggtggttcgtcgtacctgcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttttttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 758 - protein, 785 aa, Artificial Sequence
  Rd 4 combis
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKPNPEPKIQRMGDSFAVEIKGRIHFDLFPVVRRTCNLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 759 - DNA, 2355 bp, Artificial Sequence
  Rd 4 combis
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtacctgcaacctgccgacctacaccctggaagcggtgtatgaggcggttctgggcaagaccaaaagcttcctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtagctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcattctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 760 - protein, 785 aa, Artificial Sequence
  Rd 4 combis
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTCNLPTYTLEAVYEAVLGKTKSFLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGSYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 761 - DNA, 2355 bp, Artificial Sequence
  Rd 5 combis
atgcatcaccatcaccatcacggtggcagcggtatgattctggacaccgattacatcaccaaagatggcaagccgatcattcgtattttcaagaaagaaaacggcgagtttaagatcgagctggacccacactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttggtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcctgcctaagatgaaggcgaccattgacccgatcgagaagaagatgctggattaccgtcaacgtgcggttaaactgctggcgaacagctactatggttacatgggctatccgtttgcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcgactcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 762 - protein, 785 aa, Artificial Sequence
  Rd 5 combis
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFGSLYPSIIVTHNVSPDTLEKEGCENYDIAPIVSYRFCKDFPGFIPSILGDLIAMRQEILPKMKATIDPIEKKMLDYRQRAVKLLANSYYGYMGYPFARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 763 - DNA, 2355 bp, Artificial Sequence
  Rd 5 combis
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacgggcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcctgcctaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcgactcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 764 - protein, 785 aa, Artificial Sequence
  Rd 5 combis
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYGRRLRTTYLGGYVKEPEKGLWENIIYLDFRSLYPSIIVTHNVSPDTLEKEGCENYDIAPIVSYRFCKDFPGFIPSILGDLIAMRQEILPKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 765 - DNA, 2355 bp, Artificial Sequence
  Rd 5 combis
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcctgcctaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgatgtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 766 - protein, 785 aa, Artificial Sequence
  Rd 5 combis
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEILPKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 767 - DNA, 2355 bp, Artificial Sequence
  Rd 5 combis
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggaggcttttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaacagaagcgtcgtctgcgtaccacctacctgggtggctatgtgaaagagccggaaaagggtctgtgggagaacatcatttacctggactttggtagcctgtatccgcgcatcattgtgacccacaacgttagcccggacaccctggagaaggaaggctgcgaaaactacgatattgcgccgatcgttagctatcgtttctgcaaagacttcccgggttttattccgagcgcactgggcgatctgattgcgatgcgtcaggagatcctgcctaagatgaaggcgaccattgacccgatcgagctgcctatgctggattaccgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 768 - protein, 785 aa, Artificial Sequence
  Rd 5 combis
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEAFPMEAELAKLIGQSVWDVSRSSTGNLVEWYLLRVAYARNELAPNKPDEEEQKRRLRTTYLGGYVKEPEKGLWENIIYLDFGSLYPRIIVTHNVSPDTLEKEGCENYDIAPIVSYRFCKDFPGFIPSALGDLIAMRQEILPKMKATIDPIELPMLDYRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 769 - DNA, 2355 bp, Artificial Sequence
  Rd 5 combis
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacgggcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcctgcctaagatgcaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcgactcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 770 - protein, 785 aa, Artificial Sequence
  Rd 5 combis
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYGRRLRTTYLGGYVKEPEKGLWENIIYLDFRSLYPSIIVTHNVSPDTLEKEGCENYDIAPIVSYRFCKDFPGFIPSILGDLIAMRQEILPKMQATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 771 - DNA, 2355 bp, Artificial Sequence
  Rd 5 combis
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaaccgaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacgggcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcctgcctaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgatgtggtcgaaaaaatcgcgaagtaccgtgtgccgctggaaaagctggttattcacgagcaaatcacccgtgacctggatgattataaggcgattagcccgcacgtgagcatcgcgaaacgtctggcgactcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 772 - protein, 785 aa, Artificial Sequence
  Rd 5 combis
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKPNPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYGRRLRTTYLGGYVKEPEKGLWENIIYLDFRSLYPSIIVTHNVSPDTLEKEGCENYDIAPIVSYRFCKDFPGFIPSILGDLIAMRQEILPKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 773 - DNA, 2355 bp, Artificial Sequence
  Rd 5 combis
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcttcctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacgggcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcctgcctaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctggcctacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcgactcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 774 - protein, 785 aa, Artificial Sequence
  Rd 5 combis
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSFLGAEEIAAIWETEESMKKLAQYSMEDARATYELGKEFFPMEAELAKLIGQSVWDVSRSSTGNLVEWYLLRVAYARNELAPNKPDEEEYGRRLRTTYLGGYVKEPEKGLWENIIYLDFRSLYPSIIVTHNVSPDTLEKEGCENYDIAPIVSYRFCKDFPGFIPSILGDLIAMRQEILPKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLAYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 775 - DNA, 2355 bp, Artificial Sequence
  Rd 5 combis
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacgggcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcctgcctaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagcccgcacgtgagcatcgcgaaacgtctggcgactcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 776 - protein, 785 aa, Artificial Sequence
  Rd 5 combis
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYGRRLRTTYLGGYVKEPEKGLWENIIYLDFRSLYPSIIVTHNVSPDTLEKEGCENYDIAPIVSYRFCKDFPGFIPSILGDLIAMRQEILPKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 777 - DNA, 2355 bp, Artificial Sequence
  Rd 5 combis
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtggccctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcctgcctaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctggcctacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 778 - protein, 785 aa, Artificial Sequence
  Rd 5 combis
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVALVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEILPKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLAYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 779 - DNA, 2355 bp, Artificial Sequence
  Rd 5 combis
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcctgcctaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctggcctacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgatgtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 780 - protein, 785 aa, Artificial Sequence
  Rd 5 combis
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEILPKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLAYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 781 - DNA, 2355 bp, Artificial Sequence
  Rd 5 combis
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaaccgaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacgggcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcctgcctaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccagtaaggagatcgaggaaaaattcggctttaaggttctgtacgcggacaccgatggtttctatgcgaccattccgggcgaaaagccggagatcattaaaaagaaagcgcgtgagtttctggcctacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgatgtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 782 - protein, 785 aa, Artificial Sequence
  Rd 5 combis
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKPNPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYGRRLRTTYLGGYVKEPEKGLWENIIYLDFRSLYPSIIVTHNVSPDTLEKEGCENYDIAPIVSYRFCKDFPGFIPSILGDLIAMRQEILPKMKATIDPIEKKMLDYRQRAVKLLANSYYGYMGYPKARWYSKECAESVTAWGRHYIEMTSKEIEEKFGFKVLYADTDGFYATIPGEKPEIIKKKAREFLAYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 783 - DNA, 2355 bp, Artificial Sequence
  Rd 5 combis
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtggccctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcctgcctaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctggcctacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcgactcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 784 - protein, 785 aa, Artificial Sequence
  Rd 5 combis
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVALVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEILPKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLAYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 785 - DNA, 2355 bp, Artificial Sequence
  Rd 5 combis
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcctgcctaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctggcctacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcgactcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 786 - protein, 785 aa, Artificial Sequence
  Rd 5 combis
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEILPKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLAYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 787 - DNA, 2355 bp, Artificial Sequence
  Rd 5 combis
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcctgcctaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctggcctacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 788 - protein, 785 aa, Artificial Sequence
  Rd 5 combis
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEILPKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLAYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 789 - DNA, 2361 bp, Artificial Sequence
  Rd1 Fidelity SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcagagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgatgtggttgaaaaaatcgcgaagtaccgtgtgccgctggaaaagctggttattcacgagcaaatcacccgtgacctgaaagattataaggcgattggcccgcacgtgagcatcgcgaaacgtctggcgacccgtggtatcaaagtgaagccgggcaccatcattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 790 - protein, 785 aa, Artificial Sequence
  Rd1 Fidelity SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFQSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 791 - DNA, 2361 bp, Artificial Sequence
  Rd1 Fidelity SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgcttgcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgatgtggttgaaaaaatcgcgaagtaccgtgtgccgctggaaaagctggttattcacgagcaaatcacccgtgacctgaaagattataaggcgattggcccgcacgtgagcatcgcgaaacgtctggcgacccgtggtatcaaagtgaagccgggcaccatcattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 792 - protein, 785 aa, Artificial Sequence
  Rd1 Fidelity SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 793 - DNA, 2361 bp, Artificial Sequence
  Rd1 Fidelity SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagctctgaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgatgtggttgaaaaaatcgcgaagtaccgtgtgccgctggaaaagctggttattcacgagcaaatcacccgtgacctgaaagattataaggcgattggcccgcacgtgagcatcgcgaaacgtctggcgacccgtggtatcaaagtgaagccgggcaccatcattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 794 - protein, 785 aa, Artificial Sequence
  Rd1 Fidelity SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSSECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 795 - DNA, 2355 bp, Artificial Sequence
  Rd2 Fidelity SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggataatcgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctgaaagattataaggcgattggcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacgcggattactatatcgagaaccaggtgctgccggcggttctgcgtattctggaagcgttcggttaccgtaaagaggacctgcgttatcagagcagcaagcaaaccggcctggatacctggctgaaacgt

SEQ ID NO: 796 - protein, 785 aa, Artificial Sequence
  Rd2 Fidelity SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDNRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLKDYKAIGPHVSIAKRLAARGIKVKPGTIISYLVLKGSGKISDRVILLTEYDPEKHKYDADYYIENQVLPAVLRILEAFGYRKEDLRYQSSKQTGLDTWLKR

SEQ ID NO: 797 - DNA, 2361 bp, Artificial Sequence
  Rd2 Fidelity SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaaggttctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctgaaagattataaggcgattggcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacgcggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 798 - protein, 785 aa, Artificial Sequence
  Rd2 Fidelity SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKVLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLKDYKAIGPHVSIAKRLAARGIKVKPGTIISYLVLKGSGKISDRVILLTEYDPEKHKYDADYYIENQVLPAVLRILEAFGYRKEDLRYQSSKQTGLDTWLKR

SEQ ID NO: 799 - DNA, 2355 bp, Artificial Sequence
  Rd2 Fidelity SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgcgggagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctgaaagattataaggcgattggcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacgcggattactatatcgagaaccaggtgctgccggcggttctgcgtattctggaagcgttcggttaccgtaaagaggacctgcgttatcagagcagcaagcaaaccggcctggatacctggctgaaacgt

SEQ ID NO: 800 - protein, 785 aa, Artificial Sequence
  Rd2 Fidelity SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPREKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLKDYKAIGPHVSIAKRLAARGIKVKPGTIISYLVLKGSGKISDRVILLTEYDPEKHKYDADYYIENQVLPAVLRILEAFGYRKEDLRYQSSKQTGLDTWLKR

SEQ ID NO: 801 - DNA, 2361 bp, Artificial Sequence
  Rd2 Fidelity SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgataacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagtagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctgaaagattataaggcgattggcccgcacgtgagcatcgcgaaacgtctggcgactcgtggtatcaaagtgaagccgggcaccattattagctacctggttctgaaaggtagtggcaagattagcgaccgtgttatcctgctgaccgaatacgatccggagaaacacaagtatgacccagattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 802 - protein, 785 aa, Artificial Sequence
  Rd2 Fidelity SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLKDYKAIGPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 803 - DNA, 2355 bp, Artificial Sequence
  Rd2 Fidelity SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaaggatatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctgaaagattataaggcgattggcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacgcggattactatatcgagaaccaggtgctgccggcggttctgcgtattctggaagcgttcggttaccgtaaagaggacctgcgttatcagagcagcaagcaaaccggcctggatacctggctgaaacgt

SEQ ID NO: 804 - protein, 785 aa, Artificial Sequence
  Rd2 Fidelity SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKDMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLKDYKAIGPHVSIAKRLAARGIKVKPGTIISYLVLKGSGKISDRVILLTEYDPEKHKYDADYYIENQVLPAVLRILEAFGYRKEDLRYQSSKQTGLDTWLKR

SEQ ID NO: 805 - DNA, 2355 bp, Artificial Sequence
  Rd2 Fidelity SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagtataagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctgaaagattataaggcgattggcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacgcggattactatatcgagaaccaggtgctgccggcggttctgcgtattctggaagcgttcggttaccgtaaagaggacctgcgttatcagagcagcaagcaaaccggcctggatacctggctgaaacgt

SEQ ID NO: 806 - protein, 785 aa, Artificial Sequence
  Rd2 Fidelity SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEYKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLKDYKAIGPHVSIAKRLAARGIKVKPGTIISYLVLKGSGKISDRVILLTEYDPEKHKYDADYYIENQVLPAVLRILEAFGYRKEDLRYQSSKQTGLDTWLKR

SEQ ID NO: 807 - DNA, 2361 bp, Artificial Sequence
  Rd2 Fidelity SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctgaaagattataaggcgattggcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 808 - protein, 785 aa, Artificial Sequence
  Rd2 Fidelity SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLKDYKAIGPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 809 - DNA, 2361 bp, Artificial Sequence
  Rd2 Fidelity SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaatcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagcagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctgaaagattataaggcgattggcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacgcggattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 810 - protein, 785 aa, Artificial Sequence
  Rd2 Fidelity SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYNRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKQMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLKDYKAIGPHVSIAKRLAARGIKVKPGTIISYLVLKGSGKISDRVILLTEYDPEKHKYDADYYIENQVLPAVLRILEAFGYRKEDLRYQSSKQTGLDTWLKR

SEQ ID NO: 811 - DNA, 2361 bp, Artificial Sequence
  Rd2 Fidelity SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacgacaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgataacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagtatgaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagtctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgagatcgcgaaagagacccaggcgaaggtgctggaagcgattctgaaagacggtagcgttgaaaaggcggtggagattgttcgtgaagtggtcgaaaaaatcgcgaagtaccgtgtgccgctggaaaagctggttattcacgagcaaatcacccgtgacctgaaagattataaggcgattggcccgcacgtgagcatcgcgaaacgtctggcgactcgtggtatcaaagtgaagccgggcaccattattagctacctggttctgaaaggtcgtggcaagattagcgaccgtgttatcctgctgaccgaatacgatccggaggttcacaagtatgacgcagattactatatcgagaaccaggtgctgccggcggttctgcgtattctggaagcgttcggttaccgtaaagaggacctgcgttatcagagcagcaagcaaaccggcctggatacctggctgaaacgttaatga

SEQ ID NO: 812 - protein, 785 aa, Artificial Sequence
  Rd2 Fidelity SNOCAPS
MHHHHHHGGSGMILDTDYITKDGKPIIRIFKKENGEFKIELDPHFQPYIYALLKDDSAIEEIKAIKGERHDKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSMTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLKDYKAIGPHVSIAKRLATRGIKVKPGTIISYLVLKGRGKISDRVILLTEYDPEVHKYDADYYIENQVLPAVLRILEAFGYRKEDLRYQSSKQTGLDTWLKR

SEQ ID NO: 813 - DNA, 2355 bp, Artificial Sequence
  Rd3 Fidelity SNOCAPS
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaagaaaaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattcaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 814 - protein, 785 aa, Artificial Sequence
  Rd3 Fidelity SNOCAPS
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIQEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 815 - DNA, 2355 bp, Artificial Sequence
  Rd5 Fidelity combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcctgcctaagatgaaggcgaccattgacccgatcgagaagaagatgctggattaccgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcgactcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 816 - protein, 785 aa, Artificial Sequence
  Rd5 Fidelity combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEILPKMKATIDPIEKKMLDYRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 817 - DNA, 2355 bp, Artificial Sequence
  Rd5 Fidelity combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcctgcctaagatgaaggcgaccattgacccgatcgagaagaagatgctggattaccgtcaacgtgcggttaaactgctggcgaacagctactatggttacatgggctatccgtttgcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcgactcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 818 - protein, 785 aa, Artificial Sequence
  Rd5 Fidelity combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEILPKMKATIDPIEKKMLDYRQRAVKLLANSYYGYMGYPFARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 819 - DNA, 2355 bp, Artificial Sequence
  Rd5 Fidelity combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaagcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcctgcctaagatgcaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcgactcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 820 - protein, 785 aa, Artificial Sequence
  Rd5 Fidelity combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEILPKMQATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 821 - DNA, 2355 bp, Artificial Sequence
  Rd5 Fidelity combi
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccatcaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaacaggggcgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcctgcctaagatgaaggcgaccattgacccgatcgagaagaagatgctggattaccgtcaacgtgcggttaaactgctggcgaacagctactatggttacatgggctatccgaaagcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgaggtggtcgaaaaaatcgcgaagtaccgtgtgccgctggaaaagctggttattcacgagcaaatcacccgtgacctggatgattataaggcgattagcccgcacgtgagcatcgcgaaacgtctggcgactcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 822 - protein, 785 aa, Artificial Sequence
  Rd5 Fidelity combi
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEQGRRLRTTYLGGYVKEPEKGLWENIIYLDFRSLYPSIIVTHNVSPDTLEKEGCENYDIAPIVSYRFCKDFPGFIPSILGDLIAMRQEILPKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVREVVEKIAKYRVPLEKLVIHEQITRDLDDYKAISPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 823 - DNA, 2355 bp, Artificial Sequence
  DNA polymerase variant
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 824 - protein, 785 aa, Artificial Sequence; identical to SEQ ID NO: 748
  DNA polymerase variant

SEQ ID NO: 825 - DNA, 2355 bp, Artificial Sequence
  DNA polymerase variant
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctggcgtacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 826 - protein, 785 aa, Artificial Sequence
  DNA polymerase variant
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLAYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 827 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcgggtaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 828 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAGKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 829 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggcagaaacgt

SEQ ID NO: 830 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWQKR

SEQ ID NO: 831 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatgtggcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 832 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDVAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 833 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagggtgagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 834 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKGEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 835 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagactattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 836 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPETIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 837 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaagcagcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 838 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKQRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 839 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccggacgaaaagccggagatcattaaaggtaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 840 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPDEKPEIIKGKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 841 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaacgctatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 842 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNAINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 843 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagacgattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 844 - protein, 785 aa, Artificial Sequence; identical to SEQ ID NO: 836
  Rd6 Diversity

SEQ ID NO: 845 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggcggaaacgt

SEQ ID NO: 846 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWRKR

SEQ ID NO: 847 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggattctgaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 848 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDSEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 849 - DNA, 2355 bp, Artificial Sequence
  Rd6 Diversity
atgcatcaccatcaccatcacggtggcagcggtatgattctggacaccgattacagtaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 850 - protein, 785 aa, Artificial Sequence
  Rd6 Diversity
MHHHHHHGGSGMILDTDYSTKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 851 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggctattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 852 - protein, 785 aa, Artificial Sequence
  Rd6 Diversity
MHHHHHHGGSGMILDTDYITKDGKPIIRIFKKENGEFKIELDPHFQPYIYALLKDDSAIEAIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 853 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgtttaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 854 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLFKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 855 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggaggggattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 856 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEGIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 857 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttaggaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 858 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVRNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 859 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttgtggacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 860 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVVDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 861 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagaatcgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 862 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKNRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 863 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagcttattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 864 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPELIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 865 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaaagaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 866 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEKTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 867 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccggtggttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 868 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPVVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 869 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgaatgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 870 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPNVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 871 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctggtttaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 872 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWFTEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 873 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtcgctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 874 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPSLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 875 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacgggccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 876 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDGPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 877 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagccgggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 878 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEPGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 879 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccagcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgaggcgggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 880 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEAGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 881 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattctgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 882 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATILGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 883 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccggctgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 884 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPAVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 885 - DNA, 2355 bp, Artificial Sequence; identical to SEQ ID NO: 881
  Rd6 Diversity

SEQ ID NO: 886 - protein, 785 aa, Artificial Sequence; identical to SEQ ID NO: 882
  Rd6 Diversity

SEQ ID NO: 887 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagcaggcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 888 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSRRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 889 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgagcggattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 890 - protein, 785 aa, Artificial Sequence
  Rd6 Diversity
MHHHHHHGGSGMILDTDYITKDGKPIIRIFKKENGEFKIELDPHFQPYIYALLKDDSAIERIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 891 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaaccgttcggttaccgtaaagaggacctgcgttatcagagcagcaagcaaaccggcctggatacctggctgaaacgt

SEQ ID NO: 892 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEPFGYRKEDLRYQSSKQTGLDTWLKR

SEQ ID NO: 893 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagacccggtaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 894 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETRYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 895 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcgtggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 896 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSVECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 897 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcatttttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 898 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGIFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 899 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatctatagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 900 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIYSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 901 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccgtgcgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 902 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITVRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 903 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggaggtggaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 904 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWEVEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 905 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagactttagcgttgaaaaggcggtggagattgttcgtgacgttgtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 906 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDFSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 907 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggccatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 908 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGHLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 909 - DNA, 2355 bp, Artificial Sequence
  Rd6 Diversity
atgcatcaccatcaccatcacggtggcagcggtatgattctgtggaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 910 - protein, 785 aa, Artificial Sequence
  Rd6 Diversity
MHHHHHHGGSGMILWTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 911 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcatgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 912 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAHEFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 913 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctggggaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 914 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILGTEYDPEKHKYDPDYYIENQVLPAVLRILEAFGYRKEDLRYQSSKQTGLDTWLKR

SEQ ID NO: 915 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagacgcgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 916 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKTRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 917 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacgggggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 918 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYGGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 919 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgctggatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 920 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMLDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 921 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgaggggggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 922 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEGGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 923 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtaccagatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 924 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYQMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 925 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgacggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 926 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLTENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 927 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgcttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 928 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLLPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 929 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctggttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 930 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLVPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 931 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagcagggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 932 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEQGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 933 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgcataaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 934 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLHKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 935 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccaccaagggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 936 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTKGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 937 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctggcgggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 938 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLAGSGKISDRVILLTEYDPEKHKYDPDYYIENQVLPAVLRILEAFGYRKEDLRYQSSKQTGLDTWLKR

SEQ ID NO: 939 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagtggggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 940 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEWGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 941 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgattccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 942 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLIPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 943 - DNA, 2355 bp, Artificial Sequence; identical to SEQ ID NO: 917
  Rd6 Diversity

SEQ ID NO: 944 - protein, 785 aa, Artificial Sequence; identical to SEQ ID NO: 918
  Rd6 Diversity

SEQ ID NO: 945 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgtggaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 946 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYAWNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 947 - DNA, 2355 bp, Artificial Sequence; identical to SEQ ID NO: 939
  Rd6 Diversity

SEQ ID NO: 948 - protein, 785 aa, Artificial Sequence; identical to SEQ ID NO: 940
  Rd6 Diversity

SEQ ID NO: 949 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgacggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 950 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVTVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 951 - DNA, 2355 bp, Artificial Sequence
  Rd6 Diversity
atgcatcaccatcaccatcacggtggcagcggtatgattctggacaccgattacatcaccaaagatggaaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagaagggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 952 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEKGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 953 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaatggctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 954 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKWLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 955 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaacattatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 956 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNIINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 957 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaaccttgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 958 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNLDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 959 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatcagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 960 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDQFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 961 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcagtgtgttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 962 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQCVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 963 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtaggattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 964 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARRITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 965 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagacgatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 966 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEETMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 967 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtttgaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 968 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGLKVKPGTIISYLVLKGSGKISDRVILLTEYDPEKHKYDPDYYIENQVLPAVLRILEAFGYRKEDLRYQSSKQTGLDTWLKR

SEQ ID NO: 969 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccctgcgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 970 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITLRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 971 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatggtggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 972 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMVATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 973 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgatgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 974 - protein, 785 aa, Artificial Sequence
  Rd6 Diversity
MHHHHHHGGSGMILDTDYITKDGKPIIRIFKKENGEFKIELDPHFQPYIYAMLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 975 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttcggaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 976 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFRTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 977 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagcgtatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 978 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEERMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 979 - DNA, 2355 bp, Artificial Sequence
  Rd6 Diversity
atgcatcaccatcaccatcacggtggcagcggtatgactctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 980 - protein, 785 aa, Artificial Sequence
  Rd6 Diversity
MHHHHHHGGSGMTLDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 981 - DNA, 2355 bp, Artificial Sequence; identical to SEQ ID NO: 923
  Rd6 Diversity

SEQ ID NO: 982 - protein, 785 aa, Artificial Sequence; identical to SEQ ID NO: 924
  Rd6 Diversity

SEQ ID NO: 983 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatgtcgggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 984 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMSGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 985 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgctgaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 986 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDAEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 987 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagccgatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 988 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEEPMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 989 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatagtagcagcaagcaaaccggcctggatacctggctgaaacgt

SEQ ID NO: 990 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYSSSKQTGLDTWLKR

SEQ ID NO: 991 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagcctatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 992 - protein, 785 aa, Artificial Sequence; identical to SEQ ID NO: 988
  Rd6 Diversity

SEQ ID NO: 993 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtgtgctggaagctttcggttaccgtaaagaggacctgcgttatcagagcagcaagcaaaccggcctggatacctggctgaaacgt

SEQ ID NO: 994 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRVLEAFGYRKEDLRYQSSKQTGLDTWLKR

SEQ ID NO: 995 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcataccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 996 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLHTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 997 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataaggtgaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 998 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKVKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 999 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtggtcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 1000 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRGRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 1001 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtactgcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 1002 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYCKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 1003 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcaaggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 1004 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSKEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 1005 - DNA, 2355 bp, Artificial Sequence
  Rd6 Diversity
atgcatcaccatcaccatcacggtggcagcggtatgattctggggaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 1006 - protein, 785 aa, Artificial Sequence
  Rd6 Diversity
MHHHHHHGGSGMILGTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 1007 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccaggctggatacctggctgaaacgt

SEQ ID NO: 1008 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTRLDTWLKR

SEQ ID NO: 1009 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagagggtcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 1010 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEGRVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 1011 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaacccctctggatacctggctgaaacgt

SEQ ID NO: 1012 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTPLDTWLKR

SEQ ID NO: 1013 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagccggaagcaaaccggcctggatacctggctgaaacgt

SEQ ID NO: 1014 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSRKQTGLDTWLKR

SEQ ID NO: 1015 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaaaaggatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 1016 - protein, 785 aa, Artificial Sequence
  Rd6 Diversity
MHHHHHHGGSGMILDTDYITKDGKPIIRIFKKENGEFKIELDPHFQPYIYALLKKDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 1017 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttgcgaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 1018 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVANEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 1019 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatagtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 1020 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNSQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 1021 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgcaggaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 1022 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPQEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 1023 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagcctctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 1024 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKPLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 1025 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctgcttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 1026 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLLLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 1027 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctggagcgt

SEQ ID NO: 1028 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLER

SEQ ID NO: 1029 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaagggaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 1030 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEGTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 1031 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatgcggggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 1032 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMRGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 1033 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgtgggagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 1034 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAWEFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 1035 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaaattatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 1036 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKIIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 1037 - DNA, 2355 bp, Artificial Sequence
  Rd6 Diversity
atgcatcaccatcaccatcacggtggcagcggtatgattctggacaccgattacatcaccaaagatggcaagccgtcgattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 1038 - protein, 785 aa, Artificial Sequence
  Rd6 Diversity
MHHHHHHGGSGMILDTDYITKDGKPSIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 1039 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgctgagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 1040 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKALSPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 1041 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagctttcaaaccggcctggatacctggctgaaacgt

SEQ ID NO: 1042 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSFQTGLDTWLKR

SEQ ID NO: 1043 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaacctgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 1044 - protein, 785 aa, Artificial Sequence
  Rd6 Diversity
MHHHHHHGGSGMILDTDYITKDGKPIIRIFKKENGEFKIELDPHFQPYIYALLKPDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 1045 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcctgctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 1046 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGLLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 1047 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgaccagggaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 1048 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATRELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 1049 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggcgtctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 1050 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWRLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 1051 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagccctgacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcgggcaaaccggcctggatacctggctgaaacgt

SEQ ID NO: 1052 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSGQTGLDTWLKR

SEQ ID NO: 1053 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgtctgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 1054 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMSDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 1055 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtcggcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 1056 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRRRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 1057 - DNA, 2355 bp, Artificial Sequence; identical to SEQ ID NO: 1033
  Rd6 Diversity

SEQ ID NO: 1058 - protein, 785 aa, Artificial Sequence; identical to SEQ ID NO: 1034
  Rd6 Diversity

SEQ ID NO: 1059 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaatgctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 1060 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEMLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 1061 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgcgggatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 1062 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMRDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 1063 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcacgattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 1064 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFTIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 1065 - DNA, 2355 bp, Artificial Sequence
  Rd6 Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataaggcgaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 1066 - protein, 785 aa, Artificial Sequence
  Rd6 Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKAKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 1067 - DNA, 2355 bp, Artificial Sequence
  Rd6B Diversity
atgcatcaccatcaccatcacggtggcagcggtatgattctgtggaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagtttggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatgttgcgccgatcgttagctatcgtttctgcaaagacttcccgggttttattccgagcatcctgggcgatctgattgcgatgcgtcaggagatcaaaccgaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagcctgagactattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcttccaaaccgggctggatacctggcaggagcgt

SEQ ID NO: 1068 - protein, 785 aa, Artificial Sequence
  Rd6B Diversity
MHHHHHHGGSGMILWTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDVAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPETIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSFQTGLDTWQER

SEQ ID NO: 1069 - DNA, 2355 bp, Artificial Sequence
  Rd6B Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggagggcgatgaggaactgaagctgctggcgttcgacattgagaccttttaccacgaaggtgatgagtttggtaaaggcgaaatcattatgatcagctatgcggacgaggaagaggcccgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggaggtcgaagagtcgatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatgttgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagcctgagactattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccgggctggatacctggcaggagcgt

SEQ ID NO: 1070 - protein, 785 aa, Artificial Sequence
  Rd6B Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWEVEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDVAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPETIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWQER

SEQ ID NO: 1071 - DNA, 2355 bp, Artificial Sequence
  Rd6B Diversity
atgcatcaccatcaccatcacggtggcagcggtatgattctggataccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagtttggtaaaggcgaaatcattatgatcagctatgcggacgaggaagaggcccgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagcctgagactattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 1072 - protein, 785 aa, Artificial Sequence; identical to SEQ ID NO: 836
  Rd6B Diversity

SEQ ID NO: 1073 - DNA, 2355 bp, Artificial Sequence
  Rd6B Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaagcaacgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagtttggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctgctgctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaaccgaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagcctgagctgattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 1074 - protein, 785 aa, Artificial Sequence
  Rd6B Diversity
MHHHHHHGGSGMILDTDYITKDGKPIIRIFKKENGEFKIELDPHFQPYIYALLKDDSAIEEIKAIKGERHGKTVRVLDAVKQRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLLLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKPELIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 1075 - DNA, 2355 bp, Artificial Sequence
  Rd6B Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggtgctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctggttcaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagccggagatcattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 1076 - protein, 785 aa, Artificial Sequence; identical to SEQ ID NO: 872
  Rd6B Diversity

SEQ ID NO: 1077 - DNA, 2355 bp, Artificial Sequence
  Rd6B Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagtttggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaaagaccattaaggagatcgaggaaaaattcggctttaaggttctgtacgcggacaccgatggtttctatgcgaccattccgggcgaaaagcctgagattattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagaaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 1078 - protein, 785 aa, Artificial Sequence
  Rd6B Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEKTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKNRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 1079 - DNA, 2355 bp, Artificial Sequence
  Rd6B Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaagcaacgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagtaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccggttgttagctatcgtttctgcaaagacttcccgggttttattccgagcatcctgggcgatctgattgcgatgcgtcaggagatcaaaccgaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagggtgaggggattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagtaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 1080 - protein, 785 aa, Artificial Sequence
  Rd6B Diversity
MHHHHHHGGSGMILDTDYITKDGKPIIRIFKKENGEFKIELDPHFQPYIYALLKDDSAIEEIKAIKGERHGKTVRVLDAVKQRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPVVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKGEGIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 1081 - DNA, 2355 bp, Artificial Sequence
  Rd6B Diversity
atgcatcaccatcaccatcacggtggcagcggtatgattctggacaccgattacatcaccaaagatggcaagccgatcattcgtattttcaagaaagaaaacggcgagtttaagatcgagctggacccgcactttcagccgtacatttatgcgctgctgaaagacgatagcgcgatcgaggaaattaaagcgatcaagggtgaacgtcacggcaaaaccgtgcgtgttctggacgcggtgaaggttcgtaagaaattcctgggtcgtgaggtggaagtttggaagctgatctttgagcacccgcaagacgtgccggcgatgcgtgataagattaaagaacacccggcggttatcgacatttacgagtatgatatcccgtttgcgaaacgttacctgattgacaagggtctgatcccgatggaaggcgatgaggaactgaagctgctggcgttcgacattgagaccttttaccacgaaggtgatgagttcggtaaaggcgaaatcattatgatcagctatgcggacgaggaagaggcgcgtgtgattacctggaagaacatcgacctgccgtacgttgatgtggttagcaacgagcgtgaaatgatcaaacgttttgtgcaggtggttaaggagaaagacccggatgttatcattacctacaacggcgacaacttcgatctgccgtatctgatcaaacgtgcggaaaagctgggtgtgcgtctggttctgggccgtgacaaagaaaacccggagccgaagatccaacgtatgggtgatagcttcgcggtggagattaaaggccgtatccacttcgacctgtttccggtggttcgtcgtaccattaacctgccgacctacaccctggaagcggtgtatgaggcggttctgggcaagaccaaaagcaagctgggcgcggaagagattgcggcgatctgggagaccgaagagagcatgaagaaactggcgcagtacagcatggaagatgcgcgtgcgacctatgaactgggcaaggagttctttccgatggaggcggaactggcgaaactgatcggtcaaagcgtgtgggacgttagccgtagcagcaccggcaacctggtggaatggtacctgctgcgtgttgcgtatgcgcgtaacgagctggcgccgaacaaaccggatgaagaggaatacaaacgtcgtctgcgtaccacctacctgggtggctatgtgaaagagccggaaaagggtctgtgggagaacatcatttacctggactttcgtagcctgtatccgagcatcattgtgacccacaacgttagcccggacaccctggagaaggaaggctgcgaaaactacgatattgcgccgatcgttagctatcgtttctgcaaagacttcccgggttttattccgagcatcctgggcgatctgattgcgatgcgtcaggagatcaaacctaagatgaaggcgaccattgacccgcgtgagaagaagatgctggataatcgtcaacgtgcggttaaactgctggcgaacagctactatggttacatgggctatccgctggcgcgttggtacagcaaggaatgcgcggagagcgtgaccgcgtggggtcgtcactatatcgaaatgaccattaaggagatcgaggaaaaattcggctttaaggttctgtacgcggacaccgatggtttctatgcgaccattccgggcgaaaagggtgaggggattaaaaagaaagcgcgtgagtttctgaactacatcaacagcaaactgccgggtctgctggagctggaatacgagggtttctatctgcgtggcttctttgtgaccaagaaacgttatgcggttattgatgaggaaggtcgtatcaccacccgtggtctggaagtggttcgtcgtgactggagcgaaatcgcgaaagagacccaggcgaaggtgctggaagcgattctgaaagacggtagcgttgaaaaggcggtggagattgttcgtgacgtggtcgaaaaaatcgcgaagaaccgtgtgccgctggaaaagctggttattcacgagcaaatcacccgtgacctggatgattataaggcgattagtccgcacgtgagcatcgcgaaacgtctggcggctcgtggtatcaaagtgaagccgggcaccattattagctacctggttctgaaaggtagcggcaagattagcgaccgtgttatcctgctgaccgaatacgatccggagaaacacaagtatgacccggattactatatcgagaaccaggtgctgccggcggttctgcgtattctggaagctttcggttaccgtaaagaggacctgcgttatcagagcagcaagcaaaccggcctggatacctggctgaaacgt

SEQ ID NO: 1082 - protein, 785 aa, Artificial Sequence
  Rd6B Diversity
MHHHHHHGGSGMILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKPKMKATIDPREKKMLDNRQRAVKLLANSYYGYMGYPLARWYSKECAESVTAWGRHYIEMTIKEIEEKFGFKVLYADTDGFYATIPGEKGEGIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKNRVPLEKLVIHEQITRDLDDYKAISPHVSIAKRLAARGIKVKPGTIISYLVLKGSGKISDRVILLTEYDPEKHKYDPDYYIENQVLPAVLRILEAFGYRKEDLRYQSSKQTGLDTWLKR

SEQ ID NO: 1083 - DNA, 22 bp, Artificial Sequence
  Synthetic DNA
aggaggactccttatgtccaaa

SEQ ID NO: 1084 - DNA, 22 bp, Artificial Sequence
  Synthetic DNA
tcgtttacacaagtcaagtctg

SEQ ID NO: 1085 - DNA, 7976 bp, Artificial Sequence
  Synthetic DNA
aggaggactccttatgtccaaatttaattgataatggaagctggccagccaccaccacacagaattctgtagctttgaagaatgcaggtttaatatccactttgaaaaagaaaacaaataagtttatttatgctatacatgatgaaacatcttataaaggaaaaaaaataccgaaagaccaaaaatcagaactaattaactgttcagcccagtttgaagcaaatgcttttgaagcaccacttacatttgcaaatgctgattcaggtacctctgtctttttttttttgtaaatagtacatatagttttatagatgacgattccttctgtgtttttttctgctttttaaaatcttcatatcttatatttaatcttaggcatcatctgtatacatgattgtttaggtctttaattaccagtgtttagaatcaggtcactcaaacatggtagataagtttgcatagtttgtgtatatccatcactcttgagacagttttattttaagttccggggtacatgtgcaggatgtgcaggtttgttacataagtaaacgtatgccatgttggtttgctgcacctgtcaacccttcacctgagtattaagcccagcatgcattagctatttttcctggtgctctccttccccccacacacccccacctcctgacagaccctagtgtgtgttgttcccctccctgtgtccgtgtgttctcattgttcagctcccacttatgagtgagaacatgtgatgtttagttttctgttcctgcattagtttgcttaggataatggcttccagctccatctgtgtccctgcaaaggacgtgatcttgttcctttttatggctacatggtattccatggtgtatagttccacattttatttatccagtctatcattgatgggcatttgggttgattccatgtctgtgctattgtgaatagtgctgcagtgaatgtacaggtggatgtatctttataatacaatgatttatcttcctttgggtatataccccgtaatgggattgctgagtcagatggtatttttggttctaggtctttgaggaattgccacactgtcttccacaacggttgaactaatttacattccagccaacaacttgagacagtttttgactcataaacattcagagcttggctagctaattcctgctttaatttaaaaagtgtttattatatgcaaattggacaactcatataaatatgtggtgctacttactatgtattttctctaaagcatgttaaaaaaataggctagatatagtggctcatgcctgtaatcttagcactttgggaggctaaggcaggaggatcacttatggtcaggagtttaagaacaccctgggcaacatagcgagaccccatctctacaaaaaatttaaaatacccaggcatggtggcatgcttctgatgttgtagctactcaggatgctcagacaggaggatcacttgagcccaagtgactgaggctgcagtgaaccaaaattgtaccagtgcactccagcctgggccacaaaatgagaccttgtccctgaaaaaaaaaaaagaaaaaaaaaatttaaatagaggaaatactagctaagtttaatgtaggccagttctaaaataatgatttattgctgctgttgttacataattttcttaaatattttaaagattgcatactgttactgctctatttctgcatctccgtggtgtaactctgtcctctttgttgttgcaacagttcacttagcaactaaactgtatgtttacaaagtgattttatctccctatgagaagactttagtgaatagctcagtgaatagtagagttggtgagaccacagtacagaactgtttgaagtttgggttaaatttttagaggaaaatgtttgatactatgcatatcatagttaaagccaatgaaaaagctaatataggccaggcgcagtggctcacgcctataatcccagcactttgggaggccaaggcaggcagatcacttaaggtcaagagttcaagaccagcctggccaacatggtaaaaccccatctctatgaaaaaaaacaaaaattatccagatgtggtggcatgtgcctgtaatcccagctactcgggacgctaaggcaggagaatcacttgaacctgggagatggaggttgcaatgagctgagatcacgccactgcactccagcctgggtgacagaacgagactccatctcaaaaaaaaaaaaaaaaaaagctaatacatgtgatcactgatgaaatgcaattaagaactggttagtagaaaattcagagggtcaagaaatttaacagagcagttgaactcatttgcctttatcgttgagattagatcatctttcaggctgttagtatatggaccctgtttttaaaaattgtggttttgtttttttcaatgtgaaagaattaagaaaattgttacttttctaattccttttctgtgccttgcttttctgttcacaccagtattaacagcaatgaaattttttcaattttattttccaataaaaattactttgagttttttttatggtagctagctacttccttgacctagatactaattttgattgagttggtaactattattaaaaaaacaacttaggtctaatttatcttgagctaaaaaatgtaataactgaaaaatagagcatatttaggattctttctgctttaaatttgacattcagttattttcatgtaatttgtgttttgagcactaccttttaattaatttatttatttttattttttagagactgtctcattctgttacctagtctggagtgcactagtgtgatctcagctcaccgtagcctcaccctcctgggctcaagcagtccttgcacctcaccctcctgagtaactggcaccacaggcatacaccaccacacccagctaatttttatttttcatagagtcatggtctcactatgttgcccaggctagtctcgaactcctgggctcaagcagtcttcctgcctcagcctcccaaaagtgctgagattacaggcatgagccactgtgcccaaacactacctttttaacttagtgaaaaatatttagtgaatgtgattgatggtactttaattttgtcactttgtgtttttatgtttaggtttattgcattcttctgtgaaaagaagctgttcacagaatgattctgaagaaccaactttgtccttaactagctcttttgggacaattctgaggaaatgttctagaaatgaaacatgttctaataatacagtaatctctcaggatcttgattataaagaagcaaaatgtaataaggaaaaactacagttatttattaccccagaagctgattctctgtcatgcctgcaggaaggacagtgtgaaaatgatccaaaaagcaaaaaagtttcagatataaaagaagaggtcttggctgcagcatgtcacccagtacaacattcaaaagtggaatacagtgatactgactttcaatcccagaaaagtcttttatatgatcatgaaaatgccagcactcttattttaactcctacttccaaggatgttctgtcaaacctagtcatgatttctagaggcaaagaatcatacaaaatgtcagacaagctcaaaggtaacaattatgaatctgatgttgaattaaccaaaaatattcccatggaaaagaatcaagatgtatgtgctttaaatgaaaattataaaaacgttgagctgttgccacctgaaaaatacatgagagtagcatcaccttcaagaaaggtacaattcaaccaaaacacaaatctaagagtaatccaaaaaaatcaagaagaaactacttcaatttcaaaaataactgtcaatccagactctgaagaacttttctcagacaatgagaataattttgtcttccaagtagctaatgaaaggaataatcttgctttaggaaatactaaggaacttcatgaaacagacttgacttgtgtaaacgatcctcctgaggaatacaggtttaaattaactattaccttcgaccggtcggtggtggtgtgtcttaagacatcgaaacttcttacgtccaaattataggtgaaactttttcttttgtttattcaaataaatacgatatgtactactttgtagaatatttccttttttttatggctttctggtttttagtcttgattaattgacaagtcgggtcaaacttcgtttacgaaaacttcgtggtgaatgtaaacgtttacgactaagtccatggagacagaaaaaaaaaaacatttatcatgtatatcaaaatatctactgctaaggaagacacaaaaaaagacgaaaaattttagaagtatagaatataaattagaatccgtagtagacatatgtactaacaaatccagaaattaatggtcacaaatcttagtccagtgagtttgtaccatctattcaaacgtatcaaacacatataggtagtgagaactctgtcaaaataaaattcaaggccccatgtacacgtcctacacgtccaaacaatgtattcatttgcatacggtacaaccaaacgacgtggacagttgggaagtggactcataattcgggtcgtacgtaatcgataaaaaggaccacgagaggaaggggggtgtgtgggggtggaggactgtctgggatcacacacaacaaggggagggacacaggcacacaagagtaacaagtcgagggtgaatactcactcttgtacactacaaatcaaaagacaaggacgtaatcaaacgaatcctattaccgaaggtcgaggtagacacagggacgtttcctgcactagaacaaggaaaaataccgatgtaccataaggtaccacatatcaaggtgtaaaataaataggtcagatagtaactacccgtaaacccaactaaggtacagacacgataacacttatcacgacgtcacttacatgtccacctacatagaaatattatgttactaaatagaaggaaacccatatatggggcattaccctaacgactcagtctaccataaaaaccaagatccagaaactccttaacggtgtgacagaaggtgttgccaacttgattaaatgtaaggtcggttgttgaactctgtcaaaaactgagtatttgtaagtctcgaaccgatcgattaaggacgaaattaaatttttcacaaataatatacgtttaacctgttgagtatatttatacaccacgatgaatgatacataaaagagatttcgtacaatttttttatccgatctatatcaccgagtacggacattagaatcgtgaaaccctccgattccgtcctcctagtgaataccagtcctcaaattcttgtgggacccgttgtatcgctctggggtagagatgttttttaaattttatgggtccgtaccaccgtacgaagactacaacatcgatgagtcctacgagtctgtcctcctagtgaactcgggttcactgactccgacgtcacttggttttaacatggtcacgtgaggtcggacccggtgttttactctggaacagggacttttttttttttcttttttttttaaatttatctcctttatgatcgattcaaattacatccggtcaagattttattactaaataacgacgacaacaatgtattaaaagaatttataaaatttctaacgtatgacaatgacgagataaagacgtagaggcaccacattgagacaggagaaacaacaacgttgtcaagtgaatcgttgatttgacatacaaatgtttcactaaaatagagggatactcttctgaaatcacttatcgagtcacttatcatctcaaccactctggtgtcatgtcttgacaaacttcaaacccaatttaaaaatctccttttacaaactatgatacgtatagtatcaatttcggttactttttcgattatatccggtccgcgtcaccgagtgcggatattagggtcgtgaaaccctccggttccgtccgtctagtgaattccagttctcaagttctggtcggaccggttgtaccattttggggtagagatacttttttttgtttttaataggtctacaccaccgtacacggacattagggtcgatgagccctgcgattccgtcctcttagtgaacttggaccctctacctccaacgttactcgactctagtgcggtgacgtgaggtcggacccactgtcttgctctgaggtagagtttttttttttttttttttcgattatgtacactagtgactactttacgttaattcttgaccaatcatcttttaagtctcccagttctttaaattgtctcgtcaacttgagtaaacggaaatagcaactctaatctagtagaaagtccgacaatcatatacctgggacaaaaatttttaacaccaaaacaaaaaaagttacactttcttaattcttttaacaatgaaaagattaaggaaaagacacggaacgaaaagacaagtgtggtcataattgtcgttactttaaaaaagttaaaataaaaggttatttttaatgaaactcaaaaaaaataccatcgatcgatgaaggaactggatctatgattaaaactaactcaaccattgataataatttttttgttgaatccagattaaatagaactcgattttttacattattgactttttatctcgtataaatcctaagaaagacgaaatttaaactgtaagtcaataaaagtacattaaacacaaaactcgtgatggaaaattaattaaataaataaaaataaaaaatctctgacagagtaagacaatggatcagacctcacgtgatcacactagagtcgagtggcatcggagtgggaggacccgagttcgtcaggaacgtggagtgggaggactcattgaccgtggtgtccgtatgtggtggtgtgggtcgattaaaaataaaaagtatctcagtaccagagtgatacaacgggtccgatcagagcttgaggacccgagttcgtcagaaggacggagtcggagggttttcacgactctaatgtccgtactcggtgacacgggtttgtgatggaaaaattgaatcactttttataaatcacttacactaactaccatgaaattaaaacagtgaaacacaaaaatacaaatccaaataacgtaagaagacacttttcttcgacaagtgtcttactaagacttcttggttgaaacaggaattgatcgagaaaaccctgttaagactcctttacaagatctttactttgtacaagattattatgtcattagagagtcctagaactaatatttcttcgttttacattattcctttttgatgtcaataaataatggggtcttcgactaagagacagtacggacgtccttcctgtcacacttttactaggtttttcgttttttcaaagtctatattttcttctccagaaccgacgtcgtacagtgggtcatgttgtaagttttcaccttatgtcactatgactgaaagttagggtcttttcagaaaatatactagtacttttacggtcgtgagaataaaattgaggatgaaggttcctacaagacagtttggatcagtactaaagatctccgtttcttagtatgttttacagtctgttcgagtttccattgttaatacttagactacaacttaattggtttttataagggtaccttttcttagttctacatacacgaaatttacttttaatatttttgcaactcgacaacggtggactttttatgtactctcatcgtagtggaagttctttccatgttaagttggttttgtgtttagattctcattaggtttttttagttcttctttgatgaagttaaagtttttattgacagttaggtctgagacttcttgaaaagagtctgttactcttattaaaacagaaggttcatcgattactttccttattagaacgaaatcctttatgattccttgaagtactttgtctgaactgaacacatttgct

What is claimed is:

1. An engineered DNA polymerase comprising a polypeptide sequence having at least 85% or more sequence identity to the reference sequence of SEQ ID NO: 6, wherein the engineered DNA polymerase comprises a mutation at position 515 in its polypeptide sequence, and wherein the amino acid positions of the polypeptide sequence are numbered with reference to SEQ ID NO: 6.

2. The engineered DNA polymerase of claim 1, further comprising at least one substitution or substitution set at amino acid positions selected from 21, 21/66/247/282, 247/282/575, 282/575, 283/647/702/743, 339/647/661/664/668/702/712, 372/391/702, 391, 391/647/659/661/668/671/712/716, 391/647/659/661/668/671/716, 391/647/659/664/668/702/728/732, 391/647/659/664/671/702, 391/647/661/664/671/702/716, 391/647/671/728, 391/659/702/716/732/737, 391/661/664/668/671/716/737, 391/671, 391/702/712/716/732/743, 647/659/661/664/668/702, 647/659/664/668/702/712/737, 647/659/668/671/716/728, 647/668, 647/668/671/712, 659/702/743, 661/664/668/671/716, 668/702, 671/702, 671/702/716, 702, and 743, and/or any combinations thereof, wherein the amino acid positions are numbered with reference to SEQ ID NO: 6.

3. The engineered DNA polymerase of claim 1, further comprising at least one substitution or substitution set at amino acid positions selected from 18/387, 24/719, 43/528, 48/760, 101/646, 108/679, 223, 257, 282, 359, 360, 361, 362, 376/619, 390, 391, 394, 394/399, 420, 421, 478, 502, 506, 514, 521, 528, 583/730, 603, 619, 631, 646, 655, 662, 666, 668, 685, 691, 702, 721, 738, 754, 760, and 761, and/or any combinations thereof, wherein the amino acid positions are numbered with reference to SEQ ID NO: 6.

4. The engineered DNA polymerase of claim 1, further comprising at least one substitution or substitution set at amino acid positions selected from 174/361/394/666/668/721, 360/391, 361/391/659, 361/394/420/528/646/666/721/743, 361/394/420/528/666, 361/394/420/646/666/702/721/743, 361/528/646/666, 361/528/646/702/721, 361/528/666, 361/646, 394/420, 502/507/695, 528/646/659/668/743, 528/666, 528/668, 528/743, 619, 666, and 685/691/743, and/or any combinations thereof, wherein the amino acid positions are numbered with reference to SEQ ID NO: 22.

5. The engineered DNA polymerase of claim 1, wherein at least one further substitution set comprises substitutions at amino acid positions selected from 100, 277, 280, 281, 283, 339, 401, 468, 479, 480, 482, 489, 490, 491, 496, 497, and 498, and/or any combinations thereof, wherein the amino acid positions are numbered with reference to SEQ ID NO: 22.

6. The engineered DNA polymerase of claim 1, further comprising at least one substitution or substitution set at amino acid positions selected from 15/134/482/490/497/671/685, 234/497/647, 257/390/420, 257/390/420/647, 257/401/420, 257/401/420/482/647/671/685, 257/482/497/647, 257/647, 257/671/685/702, 281, 281/391/478, 281/391/478/685, 281/391/488/492, 281/391/495/561/659/668, 281/391/659/668, 281/391/668, 281/478/659/685/702, 281/478/668, 281/488, 281/488/492/495/659/668, 281/488/492/668/702, 281/488/495, 281/488/495/668, 281/492/495/668, 281/492/ 495/668/702, 281/668, 390/401/716, 390/420, 390/491/671, 390/497, 390/671/685, 391, 391/478, 391/478/479/668, 391/ 478/492/668, 391/479/659/668, 391/488/492/659/685, 391/ 488/492/668, 391/488/495/668/685/702, 391/492/495, 391/ 492/495/659, 391/492/515/659/685, 391/495/659, 401, 401/ 482/659/671/702, 401/490, 401/490/659/671, 401/671, 420, 420/482/659/702, 420/490, 420/490/659/661/671, 420/659/ 702, 420/661/671, 420/685, 478, 478/479, 478/479/668, 478/479/702, 478/488/659, 478/488/668/685/702, 478/515, 479/492, 479/659/678, 482/497/647/716, 482/497/671/685, 482/671/702/716, 488, 488/492, 488/492/495, 488/495, 488/ 495/685, 490/497/661/671/685/702/716, 492, 492/495/659/ 668, 492/659/685, 492/668/685/712, 492/668/712, 495, 495/ 659, 495/659/685, 497/647, 497/647/659/671, 497/659/691/ 716, 497/661, 497/661/671, 497/671/702, 497/671/716, 497/ 685, 497/702, 515, 659, 659/691, and 671, and/or any combinations thereof, wherein the amino acid positions are numbered with reference to SEQ ID NO: 24.

7. The engineered DNA polymerase of claim 1, further comprising at least one substitution or substitution set at amino acid positions selected from 55/579, 108, 108/521, 156/451, 236/755, 240, 247, 248, 256, 298, 299, 299/319, 302, 309, 316, 319, 350, 356, 357, 358, 370, 384, 385, 386, 389, 406, 407, 411, 415, 440, 443, 447, 450, 451, 520, 536, 539, 540, 544, 550/575, 566, 568, 575, 579, 579/767, 600, 601, 601/638, 609/648, 624, 634, 648, 656, 672, 758, 765, 767, 772, 777, 778, 779, 780, 782, 784, and 785, and/or any combinations thereof, wherein the amino acid positions are numbered with reference to SEQ ID NO: 24.

8. The engineered DNA polymerase of claim 1, further comprising at least one substitution or substitution set at amino acid positions selected from 248, 281, 281/302, 281/492, 302/401, 339/491/492/579/712, 390/466/539/712, and 661, and/or any combinations thereof, wherein the amino acid positions are numbered with reference to SEQ ID NO: 26.

9. The engineered DNA polymerase of claim 1, 240/579, further comprising at least one substitution or substitution set at amino acid positions selected from 240/579/702, 248/391/539/579/659/702, 248/391/659, 302/391/579, 339/ 390/420/425/466/490/491/515/702, 391, 391/482, 391/659, 420/515, 579, 579/659/702, 579/702, and 659/702, and/or any combinations thereof, wherein the amino acid positions are numbered with reference to SEQ ID NO: 28.

10. The engineered DNA polymerase of claim 1, further comprising at least one substitution at amino acid positions selected from 257, 420, and 521, and/or any combinations thereof, wherein the amino acid positions are numbered with reference to SEQ ID NO: 6.

11. The engineered DNA polymerase of claim 1, further comprising at least one substitution or substitution set at amino acid positions selected from 71/361/702/721/738, 277, 281, 339, 391/491, 401, 479, 480, 482, 488, 490, 491, 492, 495, 497, 528/646/659/668/743, 702/743, and 743, and/or any combinations thereof, wherein the amino acid positions are numbered with reference to SEQ ID NO: 22.

12. The engineered DNA polymerase of claim 1, further comprising at least one substitution or substitution set at amino acid positions selected from 240, 370, 385, 539, 540, 550/575, 634, and 777, and/or any combinations thereof, wherein the amino acid positions are numbered with reference to SEQ ID NO: 24.

13. The engineered DNA polymerase of claim 1, further comprising at least one substitution or substitution set at amino acid positions selected from 390/391, 482, and 515, and/or any combinations thereof, wherein the amino acid positions are numbered with reference to SEQ ID NO: 28.

14. The engineered DNA polymerase of claim 1, further comprising at least one substitution or substitution set at amino acid positions selected from 281, 281/579, and/or any combinations thereof, wherein the amino acid positions are numbered with reference to SEQ ID NO: 28.

15. The engineered DNA polymerase of claim 1, further comprising at least one substitution or substitution set at amino acid positions selected from 13, 15, 19, 26, 52, 55, 61, 80, 81, 82, 95, 111, 118, 141, 148, 152, 156, 162, 163, 179, 181, 187, 189, 191, 196, 208, 221, 229, 231, 242, 258, 274, 297, 313, 314, 317, 325, 326, 333, 349, 377, 387, 394, 395, 411, 447, 450, 451, 453, 469, 482, 496, 502, 520, 521, 537, 563, 564, 564/572, 567, 569, 575, 580, 601, 603, 619, 620, 648, 667, 673, 690, 705, 719, 731, 758, 761, 772, 774, 775, 778, 783, and 784, and/or any combinations thereof, wherein the amino acid positions are numbered with reference to SEQ ID NO: 824.

16. The engineered DNA polymerase of claim 1, further comprising at least one substitution or substitution set at amino acid positions selected from 15/447/569/775/783/ 784, 82/242/569, 82/450/567/569, 313, 314/447/569/783/ 784, 537/667, 567/569/667, and 569, and/or any combinations thereof, wherein the amino acid positions are numbered with reference to SEQ ID NO: 824.

17. The engineered DNA polymerase of claim 1, wherein said engineered DNA polymerase has DNA polymerase activity.

18. The engineered DNA polymerase of claim 1, having at least one improved property, as compared to a wild-type DNA polymerase selected from Pfu DNA polymerase from *Pyrococcus furiosus,* Group B DNA polymerase from *Thermococcus* sp. strain 2319x1, and Taq DNA polymerase from *Thermus aquaticus.*

19. The engineered DNA polymerase of claim 18, having at least one improved property, as compared to wild-type DNA polymerase, wherein said improved property is selected from producing increased product in polymerase chain reactions, greater fidelity, and greater thermostability.

20. The engineered DNA polymerase of claim 1, wherein said engineered DNA polymerase produces a greater product yield in polymerase chain reactions than wild-type DNA polymerase, wherein said wild-type DNA polymerase is selected from Pfu DNA polymerase from *Pyrococcus furiosus,* Group B DNA polymerase from *Thermococcus* sp. strain 2319x1, and Taq DNA polymerase from *Thermus aquaticus.*

21. The engineered DNA polymerase of claim 1, wherein said engineered DNA polymerase exhibits greater fidelity than wild-type DNA polymerase, wherein said wild-type DNA polymerase is selected from Pfu DNA polymerase from *Pyrococcus furiosus,* Group B DNA polymerase from *Thermococcus* sp. strain 2319x1, and Taq DNA polymerase from *Thermus aquaticus.*

22. The engineered DNA polymerase of claim 1, wherein said engineered DNA polymerase exhibits greater thermostability than wild-type DNA polymerase, wherein said wild-type DNA polymerase is selected from Pfu DNA polymerase from *Pyrococcus furiosus,* Group B DNA polymerase from *Thermococcus* sp. strain 2319x1, and Taq DNA polymerase from *Thermus aquaticus.*

23. The engineered DNA polymerase of claim 1, wherein said polymerase is purified.

24. A composition comprising the engineered DNA polymerase of claim 1.

25. The engineered DNA polymerase of claim 1, wherein the polypeptide sequence has at least 90%, 91%, 92%, 93%, 94%—or more sequence identity to the reference sequence of SEQ ID NO: 6.

26. The engineered DNA polymerase of claim 1, wherein the polypeptide sequence has at least 95%, 96%, 97%, 98%,—or more sequence identity to the reference sequence of SEQ ID NO: 6.

27. The engineered DNA polymerase of claim 1, wherein the polypeptide sequence has at least 99%—or more sequence identity to the reference sequence of SEQ ID NO: 6.

* * * * *